United States Patent
Peng et al.

(10) Patent No.: US 10,711,259 B2
(45) Date of Patent: Jul. 14, 2020

(54) COMPOSITIONS COMPRISING POLYPEPTIDES HAVING XYLANASE ACTIVITY AND POLYPEPTIDES HAVING ARABINOFURANOSIDASE ACTIVITY

(71) Applicant: Novozymes A/S, Bagsvaerd (DK)

(72) Inventors: Wei Peng, Beijing (CN); Ninfa Rangel Pedersen, Soeborg (DK); Dan Pettersson, Lynge (DK); Jens Magnus Ekloff, Copenhagen (DK); Soren Nymand-Grarup, Aabyhoej (DK); Lorena G. Palmen, Malmo (SE); Rune Nygaard Monrad, Hillerod (DK); Nikolaj Spodsberg, Bagsvaerd (DK); Mary Ann Stringer, Soeborg (DK); Charlotte Blom, Lynge (DK); Lars Kiemer, Ballerup (DK); Kristian Bertel Romer M. Krogh, Bagsvaerd (DK); Jesper Salomon, Holte (DK)

(73) Assignee: Novozymes A/S, Bagsvaerd (DK)

( * ) Notice: Subject to any disclaimer, the term of this patent is extended or adjusted under 35 U.S.C. 154(b) by 0 days.

(21) Appl. No.: 15/528,910

(22) PCT Filed: Dec. 18, 2015

(86) PCT No.: PCT/CN2015/097895
§ 371 (c)(1),
(2) Date: May 23, 2017

(87) PCT Pub. No.: WO2016/095856
PCT Pub. Date: Jun. 23, 2016

(65) Prior Publication Data
US 2017/0335302 A1    Nov. 23, 2017

(30) Foreign Application Priority Data

Dec. 19, 2014  (WO) ................ PCT/CN2014/094831
Jan. 19, 2015  (WO) ................ PCT/CN2015/071015

(51) Int. Cl.
*C12N 9/24* (2006.01)
*A23K 10/14* (2016.01)

(52) U.S. Cl.
CPC .............. *C12N 9/248* (2013.01); *A23K 10/14* (2016.05); *C12N 9/24* (2013.01); *C12N 9/2402* (2013.01); *C12Y 302/01008* (2013.01); *C12Y 302/01055* (2013.01); *C07K 2319/02* (2013.01); *C07K 2319/21* (2013.01); *C07K 2319/55* (2013.01)

(58) Field of Classification Search
None
See application file for complete search history.

(56) References Cited

U.S. PATENT DOCUMENTS

| 5,066,218 | A | 11/1991 | Silver | |
| 5,693,518 | A | 12/1997 | Kofod | |
| 6,562,340 | B1* | 5/2003 | Bedford | C12N 15/80 424/94.1 |
| 6,566,125 | B2 | 5/2003 | Johnston | |
| 2008/0171360 | A1* | 7/2008 | Lange | A21D 8/042 435/69.1 |
| 2008/0274527 | A1 | 11/2008 | Soersensen | |
| 2009/0117630 | A1* | 5/2009 | Olsen | C12P 7/06 435/161 |
| 2011/0086408 | A1 | 4/2011 | Power et al. | |
| 2011/0111453 | A1 | 5/2011 | McBrayer | |

FOREIGN PATENT DOCUMENTS

| WO | 94/21785 | A1 | 9/1994 |
| WO | 96/23062 | A1 | 8/1996 |
| WO | 02/00731 | A1 | 1/2002 |
| WO | 02/00910 | A2 | 1/2002 |
| WO | 02/00911 | A1 | 1/2002 |
| WO | 02/02644 | A1 | 1/2002 |
| WO | 2005/059084 | A1 | 6/2005 |
| WO | 2006/114095 | A1 | 11/2006 |
| WO | 2006/125438 | A1 | 11/2006 |
| WO | 2009/018537 | A2 | 2/2009 |
| WO | 2009/108941 | A2 | 9/2009 |
| WO | 2009/117689 | A1 | 9/2009 |
| WO | 2011/057140 | A1 | 5/2011 |
| WO | 2011/153516 | A2 | 12/2011 |
| WO | 2012/103288 | A1 | 8/2012 |
| WO | 2013/182669 | A2 | 12/2013 |
| WO | 2014/202716 | A1 | 12/2014 |

OTHER PUBLICATIONS

Rantanen et al., Preparation of arabinoxylobiose from rye xylan using family 10 Aspergillus aculeatus endo-1,4-β-D-xylanase, Carbohydrate Polymers, 2007, 68, 350-59.*
Wahl et al., Molecular Hybridization of Immobilized Nucleic Acids: Theoretical Concepts and Practical Considerations, Methods Enz., 1987, 152, 399-407.*
Uniprot, Accession No. S7ZW00, 2014, www.uniprot.org.*
Uniprot, Accession No. A0A1V6NXM6, 2018, www.uniprot.org.*
Sakamoto et al., Identification of a GH62 alpha-L-arabinofuranosidase specific for arabinoxylan produced by Penicillium chrysogenum, Appl. Microbiol. Biotechnol, 90, 2011, 137-47.*
Uniprot, Accession No. Uniprot B5MGR2, 2014, www.uniprot.org.*

(Continued)

*Primary Examiner* — Robert B Mondesi
*Assistant Examiner* — Todd M Epstein
(74) *Attorney, Agent, or Firm* — Elias Lambiris

(57) ABSTRACT

Compositions comprising polypeptides having xylanase activity and polypeptides having arabinofuranosidase activity for use in e.g. animal feed. Polypeptides having arabinofuranosidase activity, polypeptides having xylanase activity and polynucleotides encoding the polypeptides. Nucleic acid constructs, vectors, and host cells comprising the polynucleotides as well as methods of producing and using the polypeptide.

13 Claims, No Drawings

Specification includes a Sequence Listing.

(56) References Cited

OTHER PUBLICATIONS

Agger et al., J. Agric. Food Chem., vol. 58, pp. 6141-6148 (2010).
Gao et al., Grain Distribution Technology, vol. 6, pp. 36-42 (2012).
Huisman et al., Carbohydrate Polymers, vol. 43, pp. 269-279 (2000).
Johnston et al., Cereal Chemistry, vol. 81, pp. 626-632 (2004).
Popper et al., Plant Physiology, vol. 153, pp. 373-383 (2010).
Hashimoto et al., Journal of Bioscience and Bioengineering, vol. 95, No. 2, pp. 164-169 (2003).
Ichikawa et al, EBI Accession No. E4NJK0 (2011).
Soerensen et al., EBI Accession No. CS459135 (2007).
Kaur et al., Microbial Biotechnology, vol. 8, No. 3, pp. 419-433 (2014).
Chica et al., Current Opinion in Biotechnology, vol. 16, pp. 378-384 (2005).
Jordan et al., Biochem. J., vol. 442, pp. 241-252 (2012).
Singh et al., Current Protein and Peptide Science, vol. 18, pp. 1-11 (2017).

\* cited by examiner

COMPOSITIONS COMPRISING POLYPEPTIDES HAVING XYLANASE ACTIVITY AND POLYPEPTIDES HAVING ARABINOFURANOSIDASE ACTIVITY

CROSS-REFERENCE TO RELATED APPLICATIONS

This application is a 35 U.S.C. 371 national application of international application no. PCT/CN2015/097895 filed Dec. 18, 2015, which claims priority or the benefit under 35 U.S.C. 119 of International application nos. PCT/CN2014/094381 and PCT/CN2015/071015 filed Dec. 19, 2014 and Jan. 19, 2015, respectively. The content of these application is fully incorporated herein by reference.

REFERENCE TO A SEQUENCE LISTING

This application contains a Sequence Listing in computer readable form, which is incorporated herein by reference.

BACKGROUND OF THE INVENTION

Field of the Invention

The present invention relates to compositions comprising polypeptides having xylanase activity and polypeptides having arabinofuranosidase activity for use in e.g. animal feed. The present invention further relates to polypeptides having arabinofuranosidase activity, polypeptides having xylanase activity and polynucleotides encoding the polypeptides. The invention also relates to nucleic acid constructs, vectors, and host cells comprising the polynucleotides as well as methods of producing and using the polypeptides.

Description of the Related Art

Xylans are hemicelluloses found in all land plants (Popper and Tuohy, Plant Physiology, 2010, 153:373-383). They are especially abundant in secondary cell walls and xylem cells. In grasses, with type II cell walls, glucurono arabinoxylans are the main hemicellulose and are present as soluble or insoluble dietary fiber in many grass based food and feed products.

Plant xylans have a β-1,4-linked xylopyranose backbone that can be substituted at the O2 or O3 position with arabinose, 4-O-methyl-glucuronic acid, glucuronic acid and acetic acid in a species and tissue specific manner. The starch-rich seeds of the Panicoideae with economically important species such as corn and sorghum have special types of highly substituted xylans in their cell walls. Compared to wheat flour, wherein over 60% of the xylosyl units in the arabinoxylan backbone are unsubstituted, the corresponding percentage of unsubstituted backbone xylosyls is 20-30% in corn kernel xylan, and 35-40% in sorghum (Huismann et al. Carbohydrate Polymers, 2000, 42:269-279). Furthermore, in corn and sorghum the xylan side chains can be longer than a single arabinose or glucuronic acid substitution which is typical of other xylans. This added side chain complexity is often due to L- and D-galactose and D-xylose sugars bound to the side chain arabinose or (4-O-methyl)-glucuronic acid. About every eleventh arabinose in corn kernel xylan is also esterified with a ferulic acid and about every fifth xylose carries an acetylation (Agger et al. J. Agric. Food Chem, 2010, 58:6141-6148). All of these factors combined make the highly substituted xylans in corn and sorghum resistant to degradation by traditional xylanases.

The known enzymes responsible for the hydrolysis of carbohydrate based polymers are classified into enzyme families based on sequence similarity (www.cazy.org). The enzymes within a family share some characteristics such as 3D fold and they usually share the same reaction mechanism. Some GH families have narrow or mono-specific substrate specificities while other families have broad substrate specificities. The enzymes with mainly endo-xylanase activity have previously been described in glycoside hydrolase family (GH) 5, 8, 10, 11 and 30. The enzymes with mainly alpha-arabinofuranosidase activity have previously been described in glycoside hydrolase family (GH) 3, 43, 51, 54 and 62.

Commercially available GH10 and GH11 xylanases are often used to break down the xylose backbone of arabinoxylan. In animal feed this results in a degradation of the cereal cell wall with a subsequent improvement in nutrient release (starch and protein) encapsulated within the cells. Degradation of xylan also results in the formation of xylose oligomers that may be utilised for hind gut fermentation and therefore helps an animal to obtain more digestible energy. However, such xylanases are sensitive to side chain steric hindrance and whilst they are effective at degrading arabinoxylan from wheat, they are not very effective on the arabinoxylan found in the seeds of Panicoideae species, such as corn or sorghum.

WO2009/108941 suggests the use of over 500 different polypeptide sequences with many activities, such as cellulase, ligninase, beta glucosidase, hemicellulase, xylanase, alpha-amylase, amyloglucosidase, pectate lyase, cutinase, lipase, pectolyase, or maltogenic alpha amylase activity in a multitude of different applications. WO2009/018537 suggests the use of a number of glycosyl hydrolases having different activities and ferulic acid esterases for convert lignocellulosic biomass to fermentable sugar. WO2013/182669 discloses a number of glycosyl hydrolases having different activities from *Myriococcum thermophilum* strain CBS 389.93 and the use in biomass processing. WO2009/108941 suggests the use of yeast strains secreting multiple enzymes of different activities for biomass hydrolysis.

Corn is used around the world in animal feed and thus there is a need to discover new solutions that are capable of breaking down the highly branched xylan backbone in the cell wall in order to release more xylose and other nutrients which are trapped inside the cell wall.

SUMMARY OF THE INVENTION

The present invention relates to compositions comprising one or more GH10 or GH11 polypeptides having xylanase activity and one or more GH62 polypeptides having arabinofuranosidase activity, wherein:
 (a) the GH62 polypeptide comprises the motif [H/Y][L/M]F[F/S][A/C/H/S/T/V][A/D/G/N/R]D[D/E/N]G (SEQ ID NO: 1);
 (b) the GH10 or GH11 polypeptide and the GH62 polypeptide together solubilise at least 2.0% xylose from defatted destarched maize (DFDSM); and
 (c) the GH10 or GH11 polypeptide and the GH62 polypeptide together solubilise at least 2 times more xylose from DFDSM than the GH10 or GH11 polypeptide can when the GH62 polypeptide is not present;
 wherein (b) and (c) are performed under the reaction conditions:

i) 25 mg GH10 or GH11 polypeptide per kg DFDSM,
ii) 12.5 mg GH62 polypeptide per kg DFDSM, and
iii) incubation at 40° C., pH 5 for 4 hours.

The present application further relates to isolated polypeptides having arabinofuranosidase activity, isolated polypeptides having xylanase activity, compositions comprising polypeptides having arabinofuranosidase activity and/or xylanase activity, animal feed and animal feed additives comprising the polypeptide(s) of the invention, methods of improving the performance of an animal comprising administering to the animal the composition of the invention; methods for improving the nutritional value of an animal feed comprising administering to the animal the composition of the invention; methods of solubilising xylose from plant based material, comprising treating plant based material from the sub-family Panicoideae with the composition of the invention; methods of releasing starch from plant based material, comprising treating plant based material from the sub-family Panicoideae with the composition of the invention; methods for improving the nutritional value of an animal feed, comprising adding to the feed the composition of the invention; methods of preparing an animal feed, comprising mixing the composition of the invention with plant based material from the sub-family Panicoideae; use of the composition of the invention in animal feed, in animal feed additives, in the preparation of a composition for use in animal feed, for improving the nutritional value of an animal feed, for increasing digestibility of the animal feed, for improving one or more performance parameters in an animal, for releasing xylose from plant based material of the sub-family Panicoideae, and/or for releasing starch from plant based material of the sub-family Panicoideae, polynucleotides encoding the polypeptides of the present invention; nucleic acid constructs; expression vectors; recombinant host cells comprising the polynucleotides; and methods of producing the polypeptides.

Overview of Sequence Listing

SEQ ID NO: 1 is the GH62 conserved motif: [H/Y][L/M]F[F/S][A/C/H/S/T/V][A/D/G/N/R]D[D/E/N]G.

SEQ ID NO: 2 is the GH62 conserved motif: [H/Y]LF[F/S][A/S/V][A/D/G]DNG

SEQ ID NO: 3 is the GH62 conserved motif: YLFF[A/V][A/G]DNG

SEQ ID NO: 4 is the GH62 conserved motif: YLFFAGDNG

SEQ ID NO: 5 is the GH62 conserved motif: [H/Y]LFSSDDNG

SEQ ID NO: 6 is the GH62 conserved motif: YLFSSDDNG

SEQ ID NO: 7 is the gene sequence of GH62 arabinofuranosidase as isolated from *Penicillium capsulatum*.

SEQ ID NO: 8 is the amino acid sequence as deduced from SEQ ID NO: 7 and as disclosed as SEQ ID NO: 2 in WO2006/125438.

SEQ ID NO: 9 is the amino acid sequence of the mature GH62 arabinofuranosidase from *Penicillium capsulatum*.

SEQ ID NO: 10 is the gene sequence of GH62 arabinofuranosidase as isolated from *Penicillium aurantiogriseum*.

SEQ ID NO: 11 is the amino acid sequence as deduced from SEQ ID NO: 10.

SEQ ID NO: 12 is the amino acid sequence of the mature GH62 arabinofuranosidase from *Penicillium aurantiogriseum*.

SEQ ID NO: 13 is the codon optimised DNA sequence of the gene sequence Uniprot:XM_001273614 which is a GH62 arabinofuranosidase isolated from *Aspergillus clavatus*.

SEQ ID NO: 14 is the amino acid sequence as deduced from SEQ ID NO: 13 (Uniprot:A1CCD2) and as disclosed as SEQ ID NO: 996 in WO2014/081884.

SEQ ID NO: 15 is the amino acid sequence of the mature GH62 arabinofuranosidase from *Aspergillus clavatus*.

SEQ ID NO: 16 is the codon optimised DNA sequence of the gene sequence Uniprot:XM_001265651 which is a GH62 arabinofuranosidase isolated from *Neosartorya fischeri*.

SEQ ID NO: 17 is the amino acid sequence as deduced from SEQ ID NO: 16 (Uniprot:A1CYD5) and as disclosed as SEQ ID NO: 1177 in WO2014/081884.

SEQ ID NO: 18 is the amino acid sequence of the mature GH62 arabinofuranosidase from *Neosartorya fischeri*.

SEQ ID NO: 19 is the codon optimised DNA sequence of the gene sequence Uniprot:XM_755363 which is a GH62 arabinofuranosidase isolated from *Ustilago maydis* (see Kaemper et al, Nature, 2006, 444, 97-101).

SEQ ID NO: 20 is the amino acid sequence as deduced from SEQ ID NO: 19 (Uniprot:Q4P6F4).

SEQ ID NO: 21 is the amino acid sequence of the mature GH62 arabinofuranosidase from *Ustilago maydis*.

SEQ ID NO: 22 is the gene sequence of GH62 arabinofuranosidase as isolated from *Penicillium oxalicum*.

SEQ ID NO: 23 is the amino acid sequence as deduced from SEQ ID NO: 22.

SEQ ID NO: 24 is the amino acid sequence of the mature GH62 arabinofuranosidase from *Penicillium oxalicum*.

SEQ ID NO: 25 is the gene sequence of GH62 arabinofuranosidase as isolated from *Talaromyces pinophilus*.

SEQ ID NO: 26 is the amino acid sequence as deduced from SEQ ID NO: 25.

SEQ ID NO: 27 is the amino acid sequence of the mature GH62 arabinofuranosidase from *Talaromyces pinophilus*.

SEQ ID NO: 28 is the gene sequence of GH62 arabinofuranosidase as isolated from *Streptomyces nitrosporeus*.

SEQ ID NO: 29 is the amino acid sequence as deduced from SEQ ID NO: 28.

SEQ ID NO: 30 is the amino acid sequence of the mature GH62 arabinofuranosidase from *Streptomyces nitrosporeus*.

SEQ ID NO: 31 is the DNA sequence of the recombinant expressed DNA sequence from SEQ ID NO: 28 with His-tag and Savinase signal peptide.

SEQ ID NO: 32 is the amino acid sequence as deduced from SEQ ID NO: 31.

SEQ ID NO: 33 is the amino acid sequence of the mature GH62 arabinofuranosidase obtained from SEQ ID NO. 32.

SEQ ID NO: 34 is the gene sequence of GH62 arabinofuranosidase as isolated from *Streptomyces beijiangensis*.

SEQ ID NO: 35 is the amino acid sequence as deduced from SEQ ID NO: 34.

SEQ ID NO: 36 is the amino acid sequence of the mature GH62 arabinofuranosidase from *Streptomyces beijiangensis*.

SEQ ID NO: 37 is the DNA sequence of the recombinant expressed DNA sequence from SEQ ID NO: 34 with His-tag and Savinase signal peptide.

SEQ ID NO: 38 is the amino acid sequence as deduced from SEQ ID NO: 37.

SEQ ID NO: 39 is the amino acid sequence of the mature GH62 arabinofuranosidase obtained from SEQ ID NO. 38.

SEQ ID NO: 40 is the gene sequence of GH62 arabinofuranosidase as isolated from *Aspergillus clavatus* (see Fedorova et al, PLoS, 100046).

SEQ ID NO: 41 is the amino acid sequence as deduced from SEQ ID NO: 40.

SEQ ID NO: 42 is the amino acid sequence of the mature GH62 arabinofuranosidase from *Aspergillus clavatus*.

SEQ ID NO: 43 is the DNA sequence of the recombinant expressed DNA sequence from SEQ ID NO: 40 with His-tag.

SEQ ID NO: 44 is the amino acid sequence as deduced from SEQ ID NO: 43.

SEQ ID NO: 45 is the amino acid sequence of the mature GH62 arabinofuranosidase obtained from SEQ ID NO. 44.

SEQ ID NO: 46 is the gene sequence of GH62 arabinofuranosidase as isolated from *Aspergillus wentii*.

SEQ ID NO: 47 is the amino acid sequence as deduced from SEQ ID NO: 46.

SEQ ID NO: 48 is the amino acid sequence of the mature GH62 arabinofuranosidase from *Aspergillus wentii*.

SEQ ID NO: 49 is the DNA sequence of the recombinant expressed DNA sequence from SEQ ID NO: 46 with His-tag.

SEQ ID NO: 50 is the amino acid sequence as deduced from SEQ ID NO: 49.

SEQ ID NO: 51 is the amino acid sequence of the mature GH62 arabinofuranosidase obtained from SEQ ID NO. 50.

SEQ ID NO: 52 is the gene sequence of GH62 arabinofuranosidase as isolated from *Acrophialophora fusispora*.

SEQ ID NO: 53 is the amino acid sequence as deduced from SEQ ID NO: 52.

SEQ ID NO: 54 is the amino acid sequence of the mature GH62 arabinofuranosidase from *Acrophialophora fusispora*.

SEQ ID NO: 55 is the DNA sequence of the recombinant expressed DNA sequence from SEQ ID NO: 52 with His-tag.

SEQ ID NO: 56 is the amino acid sequence as deduced from SEQ ID NO: 55.

SEQ ID NO: 57 is the amino acid sequence of the mature GH62 arabinofuranosidase obtained from SEQ ID NO. 56.

SEQ ID NO: 58 is the gene sequence of GH62 arabinofuranosidase as isolated from *Streptosporangium* sp-60756.

SEQ ID NO: 59 is the amino acid sequence as deduced from SEQ ID NO: 58.

SEQ ID NO: 60 is the amino acid sequence of the mature GH62 arabinofuranosidase from *Streptosporangium* sp-60756.

SEQ ID NO: 61 is the DNA sequence of the recombinant expressed DNA sequence from SEQ ID NO: 58 with His-tag and Savinase signal peptide.

SEQ ID NO: 62 is the amino acid sequence as deduced from SEQ ID NO: 61.

SEQ ID NO: 63 is the amino acid sequence of the mature GH62 arabinofuranosidase obtained from SEQ ID NO. 62.

SEQ ID NO: 64 is the gene sequence of GH62 arabinofuranosidase as isolated from *Acrophialophora fusispora*.

SEQ ID NO: 65 is the amino acid sequence as deduced from SEQ ID NO: 64.

SEQ ID NO: 66 is the amino acid sequence of the mature GH62 arabinofuranosidase from *Acrophialophora fusispora*.

SEQ ID NO: 67 is the DNA sequence of the recombinant expressed DNA sequence from SEQ ID NO: 64 with His-tag.

SEQ ID NO: 68 is the amino acid sequence as deduced from SEQ ID NO: 67.

SEQ ID NO: 69 is the amino acid sequence of the mature GH62 arabinofuranosidase obtained from SEQ ID NO. 68.

SEQ ID NO: 70 is the amino acid sequence of the mature GH10 xylanase from *Aspergillus aculeatus* as disclosed as SEQ ID NO: 5 (Xyl II) in WO 1994/021785.

SEQ ID NO: 71 is the amino acid sequence of the mature GH10 xylanase from *Clostridium acetobutylicum* (Swissprot Q97TP5).

SEQ ID NO: 72 is the amino acid sequence of the mature GH10 xylanase from *Aspergillus aculeatus* as disclosed as SEQ ID NO: 8 in WO 2005/059084.

SEQ ID NO: 73 is the amino acid sequence of the mature GH11 xylanase from *Thermomyces lanuginosus* as disclosed as SEQ ID NO: 2 of WO1996/23062.

SEQ ID NO: 74 is the amino acid sequence of the mature GH11 xylanase from *Dictyoglomus thermophilum* as disclosed as SEQ ID NO: 305 of WO2011/057140.

SEQ ID NO: 75 is the amino acid sequence of the mature GH11 xylanase from *Paenibacillus pabuli* as disclosed as SEQ ID NO: 2 of WO2005/079585.

SEQ ID NO: 76 is the gene sequence of a GH11 xylanase as isolated from *Geobacillus stearothermophilus*.

SEQ ID NO: 77 is the amino acid sequence as deduced from SEQ ID NO: 76 (Swissprot: P45705).

SEQ ID NO: 78 is the amino acid sequence of the mature GH11 xylanase from *Geobacillus stearothermophilus*.

SEQ ID NO: 79 is the DNA sequence of the synthetic DNA sequence from SEQ ID NO: 76 with Savinase signal peptide.

SEQ ID NO: 80 is the amino acid sequence as deduced from SEQ ID NO: 79.

SEQ ID NO: 81 is the amino acid sequence of the mature GH11 xylanase obtained from SEQ ID NO. 80.

SEQ ID NO: 82 is the gene sequence of a GH11 xylanase as isolated from *Streptomyces beijiangensis*.

SEQ ID NO: 83 is the amino acid sequence as deduced from SEQ ID NO: 88.

SEQ ID NO: 84 is the amino acid sequence of the mature GH11 xylanase from *Streptomyces beijiangensis*.

SEQ ID NO: 85 is the DNA sequence of the recombinant expressed DNA sequence from SEQ ID NO: 82 with His-tag and Savinase signal peptide.

SEQ ID NO: 86 is the amino acid sequence as deduced from SEQ ID NO: 85.

SEQ ID NO: 87 is the amino acid sequence of the mature GH62 arabinofuranosidase obtained from SEQ ID NO: 86.

SEQ ID NO: 88 is the amino acid sequence of the mature GH11 xylanase from *Fusarium oxysporum* (FoxXyn 6) as disclosed as SEQ ID NO: 8 in WO2014/019220.

SEQ ID NO: 89 is the amino acid sequence of the mature GH11 xylanase from *Aspergillus clavatus* (AclXyn5) as disclosed as SEQ ID NO: 8 in WO2014/020143.

SEQ ID NO: 90 is the *Bacillus lentus* secretion signal.

SEQ ID NO: 91 is the His-tag RHHHHHP.

SEQ ID NO: 92 is the His-tag HHHHHHPR.

SEQ ID NO: 93 is the amino acid sequence of the GH43 arabinofuranosidase from *Humicola insolens* as disclosed as SEQ ID NO: 1 in WO2006/114095.

SEQ ID NO: 94 is the amino acid sequence of the GH51 arabinofuranosidase from *Meripilus giganteus* as disclosed as SEQ ID NO: 2 in WO2006/114095.

SEQ ID NO: 95 is the amino acid sequence of the mature GH10 xylanase XynB from *Thermotoga maritima* MSB8 as disclosed as SEQ ID NO: 1 of WO2013/068550.

SEQ ID NO: 96 is the amino acid sequence of the mature GH11 xylanase Xyl6 from *Myceliophthora thermophila* as disclosed as SEQ ID NO: 41 of WO2009/018537.

SEQ ID NO: 97 is the gene sequence of a GH11 xylanase as isolated from *Lasiodiplodia theobromae*.

SEQ ID NO: 98 is the amino acid sequence as deduced from SEQ ID NO: 97.

SEQ ID NO: 99 is the amino acid sequence of the mature GH11 xylanase from *Lasiodiplodia theobromae*.

SEQ ID NO: 100 is the gene sequence of a GH10 xylanase as isolated from *Ascobolus stictoideus*.

SEQ ID NO: 101 is the amino acid sequence as deduced from SEQ ID NO: 100.

SEQ ID NO: 102 is the amino acid sequence of the mature GH10 xylanase from *Ascobolus stictoideus*.

SEQ ID NO: 103 is the gene sequence of GH62 arabinofuranosidase as isolated from *Drechslera* sp.

SEQ ID NO: 104 is the amino acid sequence as deduced from SEQ ID NO: 104.

SEQ ID NO: 105 is the amino acid sequence of the mature GH62 arabinofuranosidase from *Drechslera* sp.

SEQ ID NO: 106 is the gene sequence of GH62 arabinofuranosidase as isolated from *Xylanibacterium* sp-61981.

SEQ ID NO: 107 is the amino acid sequence as deduced from SEQ ID NO: 106.

SEQ ID NO: 108 is the amino acid sequence of the mature GH62 arabinofuranosidase from *Xylanibacterium* sp-61981.

SEQ ID NO: 109 is the DNA sequence of the recombinant expressed DNA sequence from SEQ ID NO: 106 with His-tag.

SEQ ID NO: 110 is the amino acid sequence as deduced from SEQ ID NO: 109.

SEQ ID NO: 111 is the amino acid sequence of the mature GH62 arabinofuranosidase obtained from SEQ ID NO. 110.

SEQ ID NO: 112 is the gene sequence of GH62 arabinofuranosidase as isolated from *Microdochium nivale*.

SEQ ID NO: 113 is the amino acid sequence as deduced from SEQ ID NO: 112.

SEQ ID NO: 114 is the amino acid sequence of the mature GH62 arabinofuranosidase from *Microdochium nivale*.

SEQ ID NO: 115 is the DNA sequence of the recombinant expressed DNA sequence from SEQ ID NO: 112 with His-tag.

SEQ ID NO: 116 is the amino acid sequence as deduced from SEQ ID NO: 115.

SEQ ID NO: 117 is the amino acid sequence of the mature GH62 arabinofuranosidase obtained from SEQ ID NO. 116.

SEQ ID NO: 118 is the gene sequence of GH62 arabinofuranosidase as isolated from *Humicola hyalothermophila*.

SEQ ID NO: 119 is the amino acid sequence as deduced from SEQ ID NO: 118.

SEQ ID NO: 120 is the amino acid sequence of the mature GH62 arabinofuranosidase from *Humicola hyalothermophila*.

SEQ ID NO: 121 is the gene sequence of GH62 arabinofuranosidase as isolated from *Curvularia geniculata*.

SEQ ID NO: 122 is the amino acid sequence as deduced from SEQ ID NO: 121.

SEQ ID NO: 123 is the amino acid sequence of the mature GH62 arabinofuranosidase from *Curvularia geniculata*.

SEQ ID NO: 124 is the gene sequence of GH62 arabinofuranosidase as isolated from *Glycomyces rutgersensis*.

SEQ ID NO: 125 is the amino acid sequence as deduced from SEQ ID NO: 124.

SEQ ID NO: 126 is the amino acid sequence of the mature GH62 arabinofuranosidase from *Glycomyces rutgersensis*.

SEQ ID NO: 127 is the DNA sequence of the recombinant expressed DNA sequence from SEQ ID NO: 124 with His-tag and Savinase signal peptide.

SEQ ID NO: 128 is the amino acid sequence as deduced from SEQ ID NO: 127.

SEQ ID NO: 129 is the amino acid sequence of the mature GH62 arabinofuranosidase obtained from SEQ ID NO. 128.

SEQ ID NO: 130 is the gene sequence of GH62 arabinofuranosidase as isolated from *Coprinopsis cinerea* as disclosed in *Proc Natl Acad Sci USA*, 2010 107:11889-11894 and *Biosci Biotechnol Biochem*. 2010 75:342-345.

SEQ ID NO: 131 is the amino acid sequence as deduced from SEQ ID NO: 130.

SEQ ID NO: 132 is the amino acid sequence of the mature GH62 arabinofuranosidase from *Coprinopsis cinerea*.

SEQ ID NO: 133 is the DNA sequence of the recombinant expressed DNA sequence from SEQ ID NO: 130 with His-tag.

SEQ ID NO: 134 is the amino acid sequence as deduced from SEQ ID NO: 133.

SEQ ID NO: 135 is the amino acid sequence of the mature GH62 arabinofuranosidase obtained from SEQ ID NO. 134.

SEQ ID NO: 136 is the gene sequence of GH62 arabinofuranosidase as isolated from *Aspergillus aculeatus*.

SEQ ID NO: 137 is the amino acid sequence as deduced from SEQ ID NO: 136.

SEQ ID NO: 138 is the amino acid sequence of the mature GH62 arabinofuranosidase from *Aspergillus aculeatus*.

SEQ ID NO: 139 is the gene sequence of GH62 arabinofuranosidase as isolated from *Remersonia thermophila*.

SEQ ID NO: 140 is the amino acid sequence as deduced from SEQ ID NO: 139.

SEQ ID NO: 141 is the amino acid sequence of the mature GH62 arabinofuranosidase from *Remersonia thermophila*.

SEQ ID NO: 142 is the DNA sequence of the recombinant expressed DNA sequence from SEQ ID NO: 139 with His-tag.

SEQ ID NO: 143 is the amino acid sequence as deduced from SEQ ID NO: 142.

SEQ ID NO: 144 is the amino acid sequence of the mature GH62 arabinofuranosidase obtained from SEQ ID NO. 143.

SEQ ID NO: 145 is the gene sequence of GH62 arabinofuranosidase as isolated from *Penicillium soppii*.

SEQ ID NO: 155 is the amino acid sequence as deduced from SEQ ID NO: 145.

SEQ ID NO: 147 is the amino acid sequence of the mature GH62 arabinofuranosidase from *Penicillium soppii*.

SEQ ID NO: 148 is the gene sequence of GH62 arabinofuranosidase as isolated from *Bipolaris sorokiniana*.

SEQ ID NO: 149 is the amino acid sequence as deduced from SEQ ID NO: 148.

SEQ ID NO: 150 is the amino acid sequence of the mature GH62 arabinofuranosidase from *Bipolaris sorokiniana*.

SEQ ID NO: 151 is the DNA sequence of the recombinant expressed DNA sequence from SEQ ID NO: 148 with His-tag.

SEQ ID NO: 152 is the amino acid sequence as deduced from SEQ ID NO: 151.

SEQ ID NO: 153 is the amino acid sequence of the mature GH62 arabinofuranosidase obtained from SEQ ID NO. 152.

SEQ ID NO: 154 is the gene sequence of GH62 arabinofuranosidase as isolated from *Aspergillus fumigatiaffinis*.

SEQ ID NO: 155 is the amino acid sequence as deduced from SEQ ID NO: 154.

SEQ ID NO: 156 is the amino acid sequence of the mature GH62 arabinofuranosidase from *Aspergillus fumigatiaffinis*.

SEQ ID NO: 157 is the gene sequence of GH62 arabinofuranosidase as isolated from *Neosartorya fischeri* as disclosed in "Genomic islands in the pathogenic filamentous fungus *Aspergillus fumigatus*," PLoS. DOI: 10.1371/journal.pgen.1000046.

SEQ ID NO: 158 is the amino acid sequence as deduced from SEQ ID NO: 157.

SEQ ID NO: 159 is the amino acid sequence of the mature GH62 arabinofuranosidase from *Neosartorya fischeri*.

SEQ ID NO: 160 is the gene sequence of GH62 arabinofuranosidase as isolated from *Thielavia arenaria*.

SEQ ID NO: 161 is the amino acid sequence as deduced from SEQ ID NO: 160.

SEQ ID NO: 162 is the amino acid sequence of the mature GH62 arabinofuranosidase from *Thielavia arenaria*.

SEQ ID NO: 163 is the gene sequence of GH62 arabinofuranosidase as isolated from *Chaetomium olivicolor*.

SEQ ID NO: 164 is the amino acid sequence as deduced from SEQ ID NO: 163.

SEQ ID NO: 165 is the amino acid sequence of the mature GH62 arabinofuranosidase from *Chaetomium olivicolor*.

SEQ ID NO: 166 is the gene sequence of GH62 arabinofuranosidase as isolated from *Thielavia terricola*.

SEQ ID NO: 167 is the amino acid sequence as deduced from SEQ ID NO: 166.

SEQ ID NO: 168 is the amino acid sequence of the mature GH62 arabinofuranosidase from *Thielavia terricola*.

SEQ ID NO: 169 is the gene sequence of GH62 arabinofuranosidase as isolated from *Thielavia terricola*.

SEQ ID NO: 170 is the amino acid sequence as deduced from SEQ ID NO: 169.

SEQ ID NO: 171 is the amino acid sequence of the mature GH62 arabinofuranosidase from *Thielavia terricola*.

SEQ ID NO: 172 is the gene sequence of GH62 arabinofuranosidase as isolated from *Humicola sp*.

SEQ ID NO: 173 is the amino acid sequence as deduced from SEQ ID NO: 172.

SEQ ID NO: 174 is the amino acid sequence of the mature GH62 arabinofuranosidase from *Humicola sp*.

SEQ ID NO: 175 is the gene sequence of a GH10 xylanase as isolated from *Ustilago maydis* as disclosed in *Nature*, 2006 444:97-101.

SEQ ID NO: 176 is the amino acid sequence as deduced from SEQ ID NO: 175.

SEQ ID NO: 177 is the amino acid sequence of the mature GH10 xylanase from *Ustilago maydis*

SEQ ID NO: 178 is the DNA sequence of the recombinant expressed DNA sequence from SEQ ID NO: 175 with His-tag.

SEQ ID NO: 179 is the amino acid sequence as deduced from SEQ ID NO: 178.

SEQ ID NO: 180 is the amino acid sequence of the mature GH10 xylanase obtained from SEQ ID NO: 179.

Definitions

Allelic variant: The term "allelic variant" means any of two or more alternative forms of a gene occupying the same chromosomal locus. Allelic variation arises naturally through mutation, and may result in polymorphism within populations. Gene mutations can be silent (no change in the encoded polypeptide) or may encode polypeptides having altered amino acid sequences. An allelic variant of a polypeptide is a polypeptide encoded by an allelic variant of a gene.

Arabinofuranosidase: The term "arabinofuranosidase" means an alpha-L-arabinofuranoside arabinofuranohydrolase (EC 3.2.1.55) that catalyzes the hydrolysis of terminal non-reducing alpha-L-arabinofuranoside residues in alpha-L-arabinosides. The enzyme acts on alpha-L-arabinofuranosides, alpha-L-arabinans containing (1,3)- and/or (1,2)- and/or (1,5)-linkages, arabinoxylans, and arabinogalactans. Alpha-L-arabinofuranosidase is also known as arabinosidase, alpha-arabinosidase, alpha-L-arabinosidase, alpha-arabinofuranosidase, polysaccharide alpha-L-arabinofuranosidase, alpha-L-arabinofuranoside hydrolase, L-arabinosidase, or alpha-L-arabinanase. Arabinofuranosidase activity can be determined using 5 mg of medium viscosity wheat arabinoxylan (Megazyme International Ireland, Ltd., Bray, Co. Wicklow, Ireland) per ml of 100 mM sodium acetate pH 5 in a total volume of 200 µl for 30 minutes at 40° C. followed by arabinose analysis by AMINEX® HPX-87H column chromatography (Bio-Rad Laboratories, Inc., Hercules, Calif., USA).

The arabinofuranosidase of the present invention have at least 50% of the arabinofuranosidase activity of one or more of the polypeptides selected from the list consisting of SEQ ID NO: 9, SEQ ID NO: 12, SEQ ID NO: 15, SEQ ID NO: 18, SEQ ID NO: 21, SEQ ID NO: 24, SEQ ID NO: 27, SEQ ID NO: 30, SEQ ID NO: 33, SEQ ID NO: 36, SEQ ID NO: 39, SEQ ID NO: 42, SEQ ID NO: 45, SEQ ID NO: 48, SEQ ID NO: 51, SEQ ID NO: 54, SEQ ID NO: 57, SEQ ID NO: 60, SEQ ID NO: 63, SEQ ID NO: 66, SEQ ID NO: 69, SEQ ID NO: 105, SEQ ID NO: 108, SEQ ID NO: 111, SEQ ID NO: 114, SEQ ID NO: 117, SEQ ID NO: 120, SEQ ID NO: 123, SEQ ID NO: 126, SEQ ID NO: 129, SEQ ID NO: 132, SEQ ID NO: 135, SEQ ID NO: 138, SEQ ID NO: 141, SEQ ID NO: 144, SEQ ID NO: 147, SEQ ID NO: 150, SEQ ID NO: 153, SEQ ID NO: 156, SEQ ID NO: 159, SEQ ID NO: 162, SEQ ID NO: 165, SEQ ID NO: 168, SEQ ID NO: 171 and SEQ ID NO: 174. In a preferred embodiment, the arabinofuranosidase of the present invention have at least 70% of the arabinofuranosidase activity of one or more of the polypeptides selected from the list consisting of SEQ ID NO: 9, SEQ ID NO: 12, SEQ ID NO: 15, SEQ ID NO: 18, SEQ ID NO: 21, SEQ ID NO: 24, SEQ ID NO: 27, SEQ ID NO: 30, SEQ ID NO: 33, SEQ ID NO: 36, SEQ ID NO: 39, SEQ ID NO: 42, SEQ ID NO: 45, SEQ ID NO: 48, SEQ ID NO: 51, SEQ ID NO: 54, SEQ ID NO: 57, SEQ ID NO: 60, SEQ ID NO: 63, SEQ ID NO: 66, SEQ ID NO: 69, SEQ ID NO: 105, SEQ ID NO: 108, SEQ ID NO: 111, SEQ ID NO: 114, SEQ ID NO: 117, SEQ ID NO: 120, SEQ ID NO: 123, SEQ ID NO: 126, SEQ ID NO: 129, SEQ ID NO: 132, SEQ ID NO: 135, SEQ ID NO: 138, SEQ ID NO: 141, SEQ ID NO: 144, SEQ ID NO: 147, SEQ ID NO: 150, SEQ ID NO: 153, SEQ ID NO: 156, SEQ ID NO: 159, SEQ ID NO: 162, SEQ ID NO: 165, SEQ ID NO: 168, SEQ ID NO: 171 and SEQ ID NO: 174. In a preferred embodiment, the arabinofuranosidase of the present invention have at least 80% of the arabinofuranosidase activity of one or more of the polypeptides selected from the list consisting of SEQ ID NO: 9, SEQ ID NO: 12, SEQ ID NO: 15, SEQ ID NO: 18, SEQ ID NO: 21, SEQ ID NO: 24, SEQ ID NO: 27, SEQ ID NO: 30, SEQ ID NO: 33, SEQ ID NO: 36, SEQ ID NO: 39, SEQ ID NO: 42, SEQ ID NO: 45, SEQ ID NO: 48, SEQ ID NO: 51, SEQ ID NO: 54, SEQ ID NO: 57, SEQ ID NO: 60, SEQ ID NO: 63, SEQ ID NO: 66, SEQ ID NO: 69, SEQ ID NO: 105, SEQ ID NO: 108, SEQ ID NO: 111, SEQ ID NO: 114, SEQ ID NO: 117, SEQ ID NO: 120, SEQ ID NO: 123, SEQ ID NO: 126, SEQ ID NO: 129, SEQ ID NO: 132, SEQ ID NO: 135, SEQ ID NO: 138, SEQ ID NO: 141, SEQ ID NO: 144, SEQ ID NO: 147, SEQ ID NO: 150, SEQ ID NO: 153, SEQ ID NO: 156, SEQ ID NO: 159, SEQ ID NO: 162, SEQ ID NO: 165, SEQ ID NO: 168, SEQ ID NO: 171 and SEQ ID NO: 174. In a preferred embodiment, the arabinofuranosidase of the present invention have at least 90% of the arabinofuranosidase activity of one or more of the polypeptides selected from the list consisting of SEQ ID NO: 9, SEQ ID NO: 12, SEQ ID NO: 15, SEQ ID NO: 18, SEQ ID NO: 21, SEQ ID NO: 24, SEQ ID NO: 27, SEQ ID NO: 30, SEQ ID NO: 33, SEQ ID NO: 36, SEQ ID NO: 39, SEQ ID NO: 42, SEQ ID NO: 45, SEQ ID NO: 48, SEQ ID NO: 51, SEQ ID NO: 54, SEQ ID NO: 57, SEQ ID NO: 60, SEQ ID NO: 63, SEQ ID NO: 66, SEQ ID NO: 69, SEQ ID NO: 105, SEQ ID NO: 108, SEQ ID NO: 111, SEQ ID NO: 114, SEQ ID NO: 117, SEQ ID NO: 120, SEQ ID NO: 123, SEQ ID NO: 126, SEQ ID NO: 129, SEQ ID NO: 132, SEQ ID NO: 135, SEQ ID NO: 138, SEQ ID NO: 141, SEQ ID NO: 144, SEQ ID NO: 147, SEQ ID NO: 150, SEQ ID NO: 153, SEQ ID NO: 156, SEQ ID NO: 159, SEQ ID NO: 162, SEQ ID NO: 165, SEQ ID NO: 168, SEQ ID NO: 171 and SEQ ID NO: 174. In a preferred embodiment, the arabinofuranosidase of the present invention have at least 95% of the arabinofuranosidase activity of one or more of the polypeptides selected from the list consisting of SEQ ID NO: 9, SEQ ID NO: 12, SEQ ID NO: 15, SEQ ID NO: 18, SEQ ID NO: 21, SEQ ID NO: 24, SEQ ID NO: 27, SEQ ID NO: 30, SEQ ID NO: 33, SEQ ID NO: 36, SEQ ID NO: 39, SEQ ID NO: 42, SEQ ID NO: 45, SEQ ID NO: 48, SEQ ID NO: 51, SEQ ID NO: 54, SEQ ID NO: 57, SEQ ID NO: 60, SEQ ID NO: 63, SEQ ID NO: 66, SEQ ID NO: 69, SEQ ID NO: 105, SEQ ID NO: 108, SEQ ID NO: 111, SEQ ID NO: 114, SEQ ID NO: 117, SEQ ID NO: 120, SEQ ID NO: 123, SEQ ID NO: 126, SEQ ID NO: 129, SEQ ID NO: 132, SEQ ID NO: 135, SEQ ID NO: 138, SEQ ID NO: 141, SEQ ID NO: 144, SEQ ID NO: 147, SEQ ID NO: 150, SEQ ID NO: 153, SEQ ID NO: 156, SEQ ID NO: 159, SEQ ID NO: 162, SEQ ID NO: 165, SEQ ID NO: 168, SEQ ID NO: 171 and SEQ ID NO: 174.

In a preferred embodiment, the arabinofuranosidase of the present invention have at least 50%, such as at least 75%, at least 80%, at least 85%, at least 90%, at least 95% or at least 100% of the arabinofuranosidase activity of SEQ ID NO: 111. In a preferred embodiment, the arabinofuranosidase of the present invention have at least 50%, such as at least 75%, at least 80%, at least 85%, at least 90%, at least 95% or at least 100% of the arabinofuranosidase activity of SEQ ID NO: 24.

Arabinoxylan-containing material: The term "Arabinoxylan-containing material" means any material containing arabinoxylan. Arabinoxylan is a hemicellulose found in both the primary and secondary cell walls of plants, including woods and cereal grains, consisting of copolymers of two pentose sugars, arabinose and xylose. The arabinoxylan chain contains a large number of 1,4-linked xylose units. Many xylose units are substituted with 2-, 3- or 2,3-substituted arabinose residues.

Examples of arabinoxylan-containing material are forage, roughage, seeds and grains (either whole or prepared by crushing, milling, etc from e.g. corn, oats, rye, barley, wheat), trees or hard woods (such as poplar, willow, eucalyptus, palm, maple, birch), bamboo, herbaceous and/or woody energy crops, agricultural food and feed crops, animal feed products, cassava peels, cocoa pods, sugar cane, sugar beet, locust bean pulp, vegetable or fruit pomaces, wood waste, bark, shavings, sawdust, wood pulp, pulping liquor, waste paper, cardboard, construction and demolition wood waste, industrial or municipal waste water solids or sludge, manure, by-product from brewing and/or fermentation processes, wet distillers grain, dried distillers grain, spent grain, vinasse and bagasse.

Forage as defined herein also includes roughage. Forage is fresh plant material such as hay and silage from forage plants, grass and other forage plants, grass and other forage plants, seaweed, sprouted grains and legumes, or any combination thereof. Examples of forage plants are Alfalfa (Lucerne), birdsfoot trefoil, brassica (e.g. kale, rapeseed (canola), rutabaga (swede), turnip) clover (e.g. alsike clover, red clover, subterranean clover, white clover), grass (e.g. Bermuda grass, brome, false oat grass, fescue, heath grass, meadow grasses, miscanthus, orchard grass, ryegrass, switchgrass, Timothy-grass), corn (maize), hemp, millet, barley, oats, rye, sorghum, soybeans and wheat and vegetables such as beets. Crops suitable for ensilage are the ordinary grasses, clovers, alfalfa, vetches, oats, rye and maize. Forage further includes crop residues from grain production (such as corn stover; straw from wheat, barley, oat, rye and other grains); residues from vegetables like beet tops; residues from oilseed production like stems and leaves form soy beans, rapeseed and other legumes; and fractions from the refining of grains for animal or human consumption or from fuel production or other industries.

Roughage is generally dry plant material with high levels of fiber, such as fiber, bran, husks from seeds and grains and crop residues (such as stover, copra, straw, chaff, sugar beet waste).

Preferred sources of arabinoxylan-containing materials are forage, roughage, seeds and grains, sugar cane, sugar beet and wood pulp.

Body Weight Gain: The term "body weight gain" means an increase in live weight of an animal during a given period of time e.g. the increase in weight from day 1 to day 21.

cDNA: The term "cDNA" means a DNA molecule that can be prepared by reverse transcription from a mature, spliced, mRNA molecule obtained from a eukaryotic or prokaryotic cell. cDNA lacks intron sequences that may be present in the corresponding genomic DNA. The initial, primary RNA transcript is a precursor to mRNA that is processed through a series of steps, including splicing, before appearing as mature spliced mRNA.

Coding sequence: The term "coding sequence" means a polynucleotide, which directly specifies the amino acid sequence of a polypeptide. The boundaries of the coding sequence are generally determined by an open reading frame, which begins with a start codon such as ATG, GTG, or TTG and ends with a stop codon such as TAA, TAG, or TGA. The coding sequence may be a genomic DNA, cDNA, synthetic DNA, or a combination thereof.

Control sequences: The term "control sequences" means nucleic acid sequences necessary for expression of a polynucleotide encoding a mature polypeptide of the present invention. Each control sequence may be native (i.e., from the same gene) or foreign (i.e., from a different gene) to the polynucleotide encoding the polypeptide or native or foreign to each other. Such control sequences include, but are not limited to, a leader, polyadenylation sequence, propeptide sequence, promoter, signal peptide sequence, and transcription terminator. At a minimum, the control sequences include a promoter, and transcriptional and translational stop signals. The control sequences may be provided with linkers for the purpose of introducing specific restriction sites facilitating ligation of the control sequences with the coding region of the polynucleotide encoding a polypeptide.

Expression: The term "expression" includes any step involved in the production of a polypeptide including, but not limited to, transcription, post-transcriptional modification, translation, post-translational modification, and secretion.

Expression vector: The term "expression vector" means a linear or circular DNA molecule that comprises a polynucleotide encoding a polypeptide and is operably linked to control sequences that provide for its expression.

Feed Conversion Ratio: The term "feed conversion ratio" the amount of feed fed to an animal to increase the weight of the animal by a specified amount. An improved feed conversion ratio means a lower feed conversion ratio. By "lower feed conversion ratio" or "improved feed conversion ratio" it is meant that the use of a feed additive composition in feed results in a lower amount of feed being required to be fed to an animal to increase the weight of the animal by a specified amount compared to the amount of feed required to increase the weight of the animal by the same amount when the feed does not comprise said feed additive composition.

Feed efficiency: The term "feed efficiency" means the amount of weight gain per unit of feed when the animal is fed ad-libitum or a specified amount of food during a period of time. By "increased feed efficiency" it is meant that the use of a feed additive composition according the present invention in feed results in an increased weight gain per unit of feed intake compared with an animal fed without said feed additive composition being present.

Fragment: The term "fragment" means a polypeptide having one or more (e.g., several) amino acids absent from the amino and/or carboxyl terminus of a mature polypeptide or domain; wherein the fragment has arabinofuranosidase activity.

In one aspect, a fragment contains at least 90% of the amino acids of the mature polypeptide, such as 272 amino acids (SEQ ID NO: 8 or 9), 273 amino acids (SEQ ID NO: 11 or 12), 344 amino acids (SEQ ID NO: 14 or 15), 340 amino acids (SEQ ID NO: 17 or 18), 280 amino acids (SEQ ID NO: 20 or 21), 272 amino acids (SEQ ID NO: 23 or 24), 278 amino acids (SEQ ID NO: 26 or 27), 394 amino acids (SEQ ID NO: 29 or 30), 401 amino acids (SEQ ID NO: 32 or 33), 394 amino acids (SEQ ID NO: 35 or 36), 401 amino acids (SEQ ID NO: 38 or 39), 286 amino acids (SEQ ID NO: 41 or 42), 293 amino acids (SEQ ID NO: 44 or 45), 272 amino acids (SEQ ID NO: 47 or 48), 280 amino acids (SEQ ID NO: 50 or 51), 328 amino acids (SEQ ID NO: 53 or 54), 336 amino acids (SEQ ID NO: 56 or 57), 392 amino acids (SEQ ID NO: 59 or 60), 400 amino acids (SEQ ID NO: 62 or 63), 272 amino acids (SEQ ID NO: 65 or 66), 280 amino acids (SEQ ID NO: 68 or 69), 346 amino acids (SEQ ID NO: 70), 259 amino acids (SEQ ID NO: 71), 277 amino acids (SEQ ID NO: 72), 176 amino acids (SEQ ID NO: 73), 183 amino acids (SEQ ID NO: 74), 164 amino acids (SEQ ID NO: 75), 165 amino acids (SEQ ID NO: 77 or 78), 163 amino acids (SEQ ID NO: 80 or 81), 269 amino acids (SEQ ID NO: 83 or 84), 276 amino acids (SEQ ID NO: 86 or 87), 169 amino acids (SEQ ID NO: 88), 170 amino acids (SEQ ID NO: 89), 183 amino acids (SEQ ID NO: 98 or 99), 304 amino acids (SEQ ID NO: 101 or 102), 272 amino acids (SEQ ID NO: 104 or 105), 418 amino acids (SEQ ID NO: 107 or 108), 328 amino acids (SEQ ID NO: 113 or 114), 322 amino acids (SEQ ID NO: 119 or 120), 272 amino acids (SEQ ID NO: 122 or 123), 408 amino acids (SEQ ID NO: 125 or 126), 340 amino acids (SEQ ID NO: 131 or 132), 279 amino acids (SEQ ID NO: 137 or 138), 274 amino acids (SEQ ID NO: 140 or 141), 272 amino acids (SEQ ID NO: 146 or 147), 293 amino acids (SEQ ID NO: 148 or 149), 272 amino acids (SEQ ID NO: 149 or 150), 285 amino acids (SEQ ID NO: 155 or 156), 285 amino acids (SEQ ID NO: 158 or 159), 273 amino acids (SEQ ID NO: 161 or 162), 325 amino acids (SEQ ID NO: 164 or 165), 336 amino acids (SEQ ID NO: 167 or 168), 272 amino acids (SEQ ID NO: 170 or 171), 328 amino acids (SEQ ID NO: 173 or 174) or 291 amino acids (SEQ ID NO: 176 or 177).

In another aspect, a fragment contains at least 92% of the amino acids of the mature polypeptide, such as 278 amino acids (SEQ ID NO: 8 or 9), 279 amino acids (SEQ ID NO: 11 or 12), 351 amino acids (SEQ ID NO: 14 or 15), 348 amino acids (SEQ ID NO: 17 or 18), 286 amino acids (SEQ ID NO: 20 or 21), 278 amino acids (SEQ ID NO: 23 or 24), 284 amino acids (SEQ ID NO: 26 or 27), 403 amino acids (SEQ ID NO: 29 or 30), 410 amino acids (SEQ ID NO: 32 or 33), 403 amino acids (SEQ ID NO: 35 or 36), 410 amino acids (SEQ ID NO: 38 or 39), 293 amino acids (SEQ ID NO: 41 or 42), 300 amino acids (SEQ ID NO: 44 or 45), 278 amino acids (SEQ ID NO: 47 or 48), 286 amino acids (SEQ ID NO: 50 or 51), 335 amino acids (SEQ ID NO: 53 or 54), 343 amino acids (SEQ ID NO: 56 or 57), 401 amino acids (SEQ ID NO: 59 or 60), 408 amino acids (SEQ ID NO: 62 or 63), 278 amino acids (SEQ ID NO: 65 or 66), 286 amino acids (SEQ ID NO: 68 or 69), 353 amino acids (SEQ ID NO: 70), 265 amino acids (SEQ ID NO: 71), 283 amino acids (SEQ ID NO: 72), 179 amino acids (SEQ ID NO: 73), 187 amino acids (SEQ ID NO: 74), 167 amino acids (SEQ ID NO: 75), 168 amino acids (SEQ ID NO: 77 or 78), 167 amino acids (SEQ ID NO: 80 or 81), 275 amino acids (SEQ ID NO: 83 or 84), 282 amino acids (SEQ ID NO: 86 or 87), 173 amino acids (SEQ ID NO: 88), 174 amino acids (SEQ ID NO: 89), 187 amino acids (SEQ ID NO: 98 or 99), 311 amino acids (SEQ ID NO: 101 or 102), 278 amino acids (SEQ ID NO: 104 or 105), 427 amino acids (SEQ ID NO: 107 or 108), 335 amino acids (SEQ ID NO: 113 or 114), 329 amino acids (SEQ ID NO: 119 or 120), 278 amino acids (SEQ ID NO: 122 or 123), 417 amino acids (SEQ ID NO: 125 or 126), 347 amino acids (SEQ ID NO: 131 or 132), 285 amino acids (SEQ ID NO: 137 or 138), 280 amino acids (SEQ ID NO: 140 or 141), 278 amino acids (SEQ ID NO: 146 or 147), 299 amino acids (SEQ ID NO: 148 or 149), 278 amino acids (SEQ ID NO: 149 or 150), 291 amino acids (SEQ ID NO: 155 or 156), 291 amino acids (SEQ ID NO: 158 or 159), 279 amino acids (SEQ ID NO: 161 or 162), 333 amino acids (SEQ ID NO: 164 or 165), 344 amino acids (SEQ ID NO: 167 or 168), 278 amino acids (SEQ ID NO: 170 or 171), 335 amino acids (SEQ ID NO: 173 or 174) or 298 amino acids (SEQ ID NO: 176 or 177).

In another aspect, a fragment contains at least 94% of the amino acids of the mature polypeptide, such as 284 amino acids (SEQ ID NO: 8 or 9), 285 amino acids (SEQ ID NO: 11 or 12), 359 amino acids (SEQ ID NO: 14 or 15), 355 amino acids (SEQ ID NO: 17 or 18), 292 amino acids (SEQ ID NO: 20 or 21), 284 amino acids (SEQ ID NO: 23 or 24), 290 amino acids (SEQ ID NO: 26 or 27), 412 amino acids (SEQ ID NO: 29 or 30), 419 amino acids (SEQ ID NO: 32 or 33), 412 amino acids (SEQ ID NO: 35 or 36), 419 amino acids (SEQ ID NO: 38 or 39), 299 amino acids (SEQ ID NO: 41 or 42), 306 amino acids (SEQ ID NO: 44 or 45), 284 amino acids (SEQ ID NO: 47 or 48), 292 amino acids (SEQ ID NO: 50 or 51), 342 amino acids (SEQ ID NO: 53 or 54), 351 amino acids (SEQ ID NO: 56 or 57), 410 amino acids (SEQ ID NO: 59 or 60), 417 amino acids (SEQ ID NO: 62 or 63), 284 amino acids (SEQ ID NO: 65 or 66), 292 amino acids (SEQ ID NO: 68 or 69), 361 amino acids (SEQ ID NO: 70), 271 amino acids (SEQ ID NO: 71), 290 amino acids (SEQ ID NO: 72), 183 amino acids (SEQ ID NO: 73), 191 amino acids (SEQ ID NO: 74), 171 amino acids (SEQ ID NO: 75), 172 amino acids (SEQ ID NO: 77 or 78), 170 amino acids (SEQ ID NO: 80 or 81), 281 amino acids (SEQ ID NO: 83 or 84), 289 amino acids (SEQ ID NO: 86 or 87), 177 amino acids (SEQ ID NO: 88), 178 amino acids (SEQ ID NO: 89), 191 amino acids (SEQ ID NO: 98 or 99), 317 amino acids (SEQ ID NO: 101 or 102), 284 amino acids (SEQ ID NO: 104 or 105), 437 amino acids (SEQ ID NO: 107 or 108), 343 amino acids (SEQ ID NO: 113 or 114), 336 amino acids (SEQ ID NO: 119 or 120), 284 amino acids (SEQ ID NO: 122 or 123), 426 amino acids (SEQ ID NO: 125 or 126), 355 amino acids (SEQ ID NO: 131 or 132), 291 amino acids (SEQ ID NO: 137 or 138), 286 amino acids (SEQ ID NO: 140 or 141), 284 amino acids (SEQ ID NO: 146 or 147), 306 amino acids (SEQ ID NO: 148 or 149), 284 amino acids (SEQ ID NO: 149 or 150), 298 amino acids (SEQ ID NO: 155 or 156), 298 amino acids (SEQ ID NO: 158 or 159), 285 amino acids (SEQ ID NO: 161 or 162), 340 amino acids (SEQ ID NO: 164 or 165), 351 amino acids (SEQ ID NO: 167 or 168), 284 amino acids (SEQ ID NO: 170 or 171), 343 amino acids (SEQ ID NO: 173 or 174) or 304 amino acids (SEQ ID NO: 176 or 177).

In another aspect, a fragment contains at least 96% of the amino acids of the mature polypeptide, such as 290 amino acids (SEQ ID NO: 8 or 9), 291 amino acids (SEQ ID NO: 11 or 12), 367 amino acids (SEQ ID NO: 14 or 15), 363 amino acids (SEQ ID NO: 17 or 18), 299 amino acids (SEQ ID NO: 20 or 21), 290 amino acids (SEQ ID NO: 23 or 24), 297 amino acids (SEQ ID NO: 26 or 27), 420 amino acids (SEQ ID NO: 29 or 30), 428 amino acids (SEQ ID NO: 32 or 33), 420 amino acids (SEQ ID NO: 35 or 36), 428 amino acids (SEQ ID NO: 38 or 39), 305 amino acids (SEQ ID NO: 41 or 42), 313 amino acids (SEQ ID NO: 44 or 45), 290 amino acids (SEQ ID NO: 47 or 48), 299 amino acids (SEQ ID NO: 50 or 51), 349 amino acids (SEQ ID NO: 53 or 54), 358 amino acids (SEQ ID NO: 56 or 57), 419 amino acids (SEQ ID NO: 59 or 60), 426 amino acids (SEQ ID NO: 62 or 63), 290 amino acids (SEQ ID NO: 65 or 66), 299 amino acids (SEQ ID NO: 68 or 69), 369 amino acids (SEQ ID NO: 70), 276 amino acids (SEQ ID NO: 71), 296 amino acids (SEQ ID NO: 72), 187 amino acids (SEQ ID NO: 73), 195 amino acids (SEQ ID NO: 74), 175 amino acids (SEQ ID NO: 75), 176 amino acids (SEQ ID NO: 77 or 78), 174 amino acids (SEQ ID NO: 80 or 81), 287 amino acids (SEQ ID NO: 83 or 84), 295 amino acids (SEQ ID NO: 86 or 87), 180 amino acids (SEQ ID NO: 88), 181 amino acids (SEQ ID NO: 89), 195 amino acids (SEQ ID NO: 98 or 99), 324 amino acids (SEQ ID NO: 101 or 102), 290 amino acids (SEQ ID NO: 104 or 105), 446 amino acids (SEQ ID NO: 107 or 108), 350 amino acids (SEQ ID NO: 113 or 114), 343 amino acids (SEQ ID NO: 119 or 120), 290 amino acids (SEQ ID NO: 122 or 123), 435 amino acids (SEQ ID NO: 125 or 126), 362 amino acids (SEQ ID NO: 131 or 132), 297 amino acids (SEQ ID NO: 137 or 138), 292 amino acids (SEQ ID NO: 140 or 141), 290 amino acids (SEQ ID NO: 146 or 147), 312 amino acids (SEQ ID NO: 148 or 149), 290 amino acids (SEQ ID NO: 149 or 150), 304 amino acids (SEQ ID NO: 155 or 156), 304 amino acids (SEQ ID NO: 158 or 159), 291 amino acids (SEQ ID NO: 161 or 162), 347 amino acids (SEQ ID NO: 164 or 165), 359 amino acids (SEQ ID NO: 167 or 168), 290 amino acids (SEQ ID NO: 170 or 171), 350 amino acids (SEQ ID NO: 173 or 174) or 311 amino acids (SEQ ID NO: 176 or 177).

In another aspect, a fragment contains at least 98% of the amino acids of the mature polypeptide, such as 296 amino acids (SEQ ID NO: 8 or 9), 297 amino acids (SEQ ID NO: 11 or 12), 374 amino acids (SEQ ID NO: 14 or 15), 370 amino acids (SEQ ID NO: 17 or 18), 305 amino acids (SEQ ID NO: 20 or 21), 296 amino acids (SEQ ID NO: 23 or 24), 303 amino acids (SEQ ID NO: 26 or 27), 429 amino acids (SEQ ID NO: 29 or 30), 437 amino acids (SEQ ID NO: 32 or 33), 429 amino acids (SEQ ID NO: 35 or 36), 437 amino acids (SEQ ID NO: 38 or 39), 312 amino acids (SEQ ID NO: 41 or 42), 319 amino acids (SEQ ID NO: 44 or 45), 296 amino acids (SEQ ID NO: 47 or 48), 305 amino acids (SEQ ID NO: 50 or 51), 357 amino acids (SEQ ID NO: 53 or 54), 366 amino acids (SEQ ID NO: 56 or 57), 427 amino acids (SEQ ID NO: 59 or 60), 435 amino acids (SEQ ID NO: 62 or 63), 296 amino acids (SEQ ID NO: 65 or 66), 305 amino acids (SEQ ID NO: 68 or 69), 376 amino acids (SEQ ID NO: 70), 282 amino acids (SEQ ID NO: 71), 302 amino acids (SEQ ID NO: 72), 191 amino acids (SEQ ID NO: 73), 199 amino acids (SEQ ID NO: 74), 178 amino acids (SEQ ID NO: 75), 179 amino acids (SEQ ID NO: 77 or 78), 177 amino acids (SEQ ID NO: 80 or 81), 293 amino acids (SEQ ID NO: 83 or 84), 301 amino acids (SEQ ID NO: 86 or 87), 184 amino acids (SEQ ID NO: 88), 185 amino acids (SEQ ID NO: 89), 199 amino acids (SEQ ID NO: 98 or 99), 331 amino acids (SEQ ID NO: 101 or 102), 296 amino acids (SEQ ID NO: 104 or 105), 455 amino acids (SEQ ID NO: 107 or 108), 357 amino acids (SEQ ID NO: 113 or 114), 350 amino acids (SEQ ID NO: 119 or 120), 296 amino acids (SEQ ID NO: 122 or 123), 444 amino acids (SEQ ID NO: 125 or 126), 370 amino acids (SEQ ID NO: 131 or 132), 303 amino acids (SEQ ID NO: 137 or 138), 298 amino acids (SEQ ID NO: 140 or 141), 296 amino acids (SEQ ID NO: 146 or 147), 319 amino acids (SEQ ID NO: 148 or 149), 296 amino acids (SEQ ID NO: 149 or 150), 310 amino acids (SEQ ID NO: 155 or 156), 310 amino acids (SEQ ID NO: 158 or 159), 297 amino acids (SEQ ID NO: 161 or 162), 354 amino acids (SEQ ID NO: 164 or 165), 366 amino acids (SEQ ID NO: 167 or 168), 296 amino acids (SEQ ID NO: 170 or 171), 357 amino acids (SEQ ID NO: 173 or 174) or 317 amino acids (SEQ ID NO: 176 or 177).

In another aspect, a fragment contains at least 99% of the amino acids of the mature polypeptide, such as 299 amino acids (SEQ ID NO: 8 or 9), 300 amino acids (SEQ ID NO: 11 or 12), 378 amino acids (SEQ ID NO: 14 or 15), 374 amino acids (SEQ ID NO: 17 or 18), 308 amino acids (SEQ ID NO: 20 or 21), 299 amino acids (SEQ ID NO: 23 or 24), 306 amino acids (SEQ ID NO: 26 or 27), 434 amino acids (SEQ ID NO: 29 or 30), 442 amino acids (SEQ ID NO: 32 or 33), 434 amino acids (SEQ ID NO: 35 or 36), 442 amino acids (SEQ ID NO: 38 or 39), 315 amino acids (SEQ ID NO: 41 or 42), 323 amino acids (SEQ ID NO: 44 or 45), 299 amino acids (SEQ ID NO: 47 or 48), 308 amino acids (SEQ ID NO: 50 or 51), 360 amino acids (SEQ ID NO: 53 or 54), 369 amino acids (SEQ ID NO: 56 or 57), 432 amino acids (SEQ ID NO: 59 or 60), 440 amino acids (SEQ ID NO: 62 or 63), 299 amino acids (SEQ ID NO: 65 or 66), 308 amino acids (SEQ ID NO: 68 or 69), 380 amino acids (SEQ ID NO: 70), 285 amino acids (SEQ ID NO: 71), 305 amino acids (SEQ ID NO: 72), 193 amino acids (SEQ ID NO: 73), 201 amino acids (SEQ ID NO: 74), 180 amino acids (SEQ ID NO: 75), 181 amino acids (SEQ ID NO: 77 or 78), 179 amino acids (SEQ ID NO: 80 or 81), 296 amino acids (SEQ ID NO: 83 or 84), 304 amino acids (SEQ ID NO: 86 or 87), 186 amino acids (SEQ ID NO: 88), 187 amino acids (SEQ ID NO: 89), 201 amino acids (SEQ ID NO: 98 or 99), 334 amino acids (SEQ ID NO: 101 or 102), 299 amino acids (SEQ ID NO: 104 or 105), 460 amino acids (SEQ ID NO: 107 or 108), 361 amino acids (SEQ ID NO: 113 or 114), 354 amino acids (SEQ ID NO: 119 or 120), 299 amino acids (SEQ ID NO: 122 or 123), 449 amino acids (SEQ ID NO: 125 or 126), 374 amino acids (SEQ ID NO: 131 or 132), 306 amino acids (SEQ ID NO: 137 or 138), 301 amino acids (SEQ ID NO: 140 or 141), 299 amino acids (SEQ ID NO: 146 or 147), 322 amino acids (SEQ ID NO: 148 or 149), 299 amino acids (SEQ ID NO: 149 or 150), 313 amino acids (SEQ ID NO: 155 or 156), 313 amino acids (SEQ ID NO: 158 or 159), 300 amino acids (SEQ ID NO: 161 or 162), 358 amino acids (SEQ ID NO: 164 or 165), 370 amino acids (SEQ ID NO: 167 or 168), 299 amino acids (SEQ ID NO: 170 or 171), 361 amino acids (SEQ ID NO: 173 or 174) or 320 amino acids (SEQ ID NO: 176 or 177).

Highly branched xylan: The term "highly branched xylan" means that more than 50% of xylosyl units in the arabinoxylan backbone are substituted. This is preferably calculated from linkage analysis as performed in Huismann et al. Carbohydrate Polymers, 2000, 42:269-279.

Host cell: The term "host cell" means any cell type that is susceptible to transformation, transfection, transduction, or the like with a nucleic acid construct or expression vector comprising a polynucleotide of the present invention. The term "host cell" encompasses any progeny of a parent cell that is not identical to the parent cell due to mutations that occur during replication.

Isolated: The term "isolated" means a substance in a form or environment that does not occur in nature. Non-limiting examples of isolated substances include (1) any non-naturally occurring substance, (2) any substance including, but not limited to, any enzyme, variant, nucleic acid, protein, peptide or cofactor, that is at least partially removed from one or more or all of the naturally occurring constituents with which it is associated in nature; (3) any substance modified by the hand of man relative to that substance found in nature; or (4) any substance modified by increasing the amount of the substance relative to other components with which it is naturally associated (e.g., recombinant production in a host cell; multiple copies of a gene encoding the substance; and use of a stronger promoter than the promoter naturally associated with the gene encoding the substance).

Mature polypeptide: The term "mature polypeptide" means a polypeptide in its final form following translation and any post-translational modifications, such as N-terminal processing, C-terminal truncation, glycosylation, phosphorylation, etc.

In one aspect, the mature polypeptide is amino acids 1 to 302 of SEQ ID NO: 8 and amino acids −26 to −1 of SEQ ID NO: 2 are a signal peptide. In another aspect, the mature polypeptide is amino acids 1 to 302 of SEQ ID NO: 9.

In one aspect, the mature polypeptide is amino acids 1 to 303 of SEQ ID NO: 11 and amino acids −26 to −1 of SEQ ID NO: 11 are a signal peptide. In another aspect, the mature polypeptide is amino acids 1 to 303 of SEQ ID NO: 12.

In one aspect, the mature polypeptide is amino acids 1 to 382 of SEQ ID NO: 14 and amino acids −21 to −1 of SEQ ID NO: 15 are a signal peptide. In another aspect, the mature polypeptide is amino acids 1 to 382 of SEQ ID NO: 15.

In one aspect, the mature polypeptide is amino acids 1 to 378 of SEQ ID NO: 17 and amino acids −17 to −1 of SEQ ID NO: 17 are a signal peptide. In another aspect, the mature polypeptide is amino acids 1 to 378 of SEQ ID NO: 18.

In one aspect, the mature polypeptide is amino acids 1 to 311 of SEQ ID NO: 20 and amino acids −20 to −1 of SEQ ID NO: 20 are a signal peptide. In another aspect, the mature polypeptide is amino acids 1 to 311 of SEQ ID NO: 21.

In one aspect, the mature polypeptide is amino acids 1 to 302 of SEQ ID NO: 23 and amino acids −29 to −1 of SEQ ID NO: 23 are a signal peptide. In another aspect, the mature polypeptide is amino acids 1 to 302 of SEQ ID NO: 24.

In one aspect, the mature polypeptide is amino acids 1 to 309 of SEQ ID NO: 26 and amino acids −16 to −1 of SEQ ID NO: 26 are a signal peptide. In another aspect, the mature polypeptide is amino acids 1 to 309 of SEQ ID NO: 27.

In one aspect, the mature polypeptide is amino acids 1 to 438 of SEQ ID NO: 29 and amino acids −36 to −1 of SEQ ID NO: 29 are a signal peptide. In another aspect, the mature polypeptide is amino acids 1 to 438 of SEQ ID NO: 30. In one aspect, the mature polypeptide is amino acids 1 to 446 of SEQ ID NO: 32 and amino acids −27 to −1 of SEQ ID NO: 32 are a signal peptide. In another aspect, the mature polypeptide is amino acids 1 to 446 of SEQ ID NO: 33.

In one aspect, the mature polypeptide is amino acids 1 to 438 of SEQ ID NO: 35 and amino acids −36 to −1 of SEQ ID NO: 35 are a signal peptide. In another aspect, the mature polypeptide is amino acids 1 to 438 of SEQ ID NO: 36. In one aspect, the mature polypeptide is amino acids 1 to 446 of SEQ ID NO: 38 and amino acids −27 to −1 of SEQ ID NO: 38 are a signal peptide. In another aspect, the mature polypeptide is amino acids 1 to 446 of SEQ ID NO: 39.

In one aspect, the mature polypeptide is amino acids 1 to 318 of SEQ ID NO: 41 and amino acids −18 to −1 of SEQ ID NO: 41 are a signal peptide. In another aspect, the mature polypeptide is amino acids 1 to 318 of SEQ ID NO: 42. In one aspect, the mature polypeptide is amino acids 1 to 326 of SEQ ID NO: 44 and amino acids −18 to −1 of SEQ ID NO: 44 are a signal peptide. In another aspect, the mature polypeptide is amino acids 1 to 326 of SEQ ID NO: 45.

In one aspect, the mature polypeptide is amino acids 1 to 302 of SEQ ID NO: 47 and amino acids −25 to −1 of SEQ ID NO: 47 are a signal peptide. In another aspect, the mature polypeptide is amino acids 1 to 302 of SEQ ID NO: 48. In one aspect, the mature polypeptide is amino acids 1 to 311 of SEQ ID NO: 50 and amino acids −25 to −1 of SEQ ID NO: 50 are a signal peptide. In another aspect, the mature polypeptide is amino acids 1 to 311 of SEQ ID NO: 51.

In one aspect, the mature polypeptide is amino acids 1 to 364 of SEQ ID NO: 53 and amino acids −24 to −1 of SEQ ID NO: 53 are a signal peptide. In another aspect, the mature polypeptide is amino acids 1 to 364 of SEQ ID NO: 54. In one aspect, the mature polypeptide is amino acids 1 to 373 of SEQ ID NO: 56 and amino acids −24 to −1 of SEQ ID NO: 56 are a signal peptide. In another aspect, the mature polypeptide is amino acids 1 to 373 of SEQ ID NO: 57.

In one aspect, the mature polypeptide is amino acids 1 to 436 of SEQ ID NO: 59 and amino acids −31 to −1 of SEQ ID NO: 59 are a signal peptide. In another aspect, the mature polypeptide is amino acids 1 to 436 of SEQ ID NO: 60. In one aspect, the mature polypeptide is amino acids 1 to 444 of SEQ ID NO: 62 and amino acids −27 to −1 of SEQ ID NO: 62 are a signal peptide. In another aspect, the mature polypeptide is amino acids 1 to 444 of SEQ ID NO: 63.

In one aspect, the mature polypeptide is amino acids 1 to 302 of SEQ ID NO: 65 and amino acids −19 to −1 of SEQ ID NO: 65 are a signal peptide. In another aspect, the mature polypeptide is amino acids 1 to 302 of SEQ ID NO: 66. In one aspect, the mature polypeptide is amino acids 1 to 311 of SEQ ID NO: 68 and amino acids −19 to −1 of SEQ ID NO: 68 are a signal peptide. In another aspect, the mature polypeptide is amino acids 1 to 311 of SEQ ID NO: 69.

In one aspect, the mature polypeptide is amino acids 1 to 183 of SEQ ID NO: 77 and amino acids −27 to −1 of SEQ ID NO: 77 are a signal peptide. In another aspect, the mature polypeptide is amino acids 1 to 302 of SEQ ID NO: 78. In one aspect, the mature polypeptide is amino acids 1 to 181 of SEQ ID NO: 80 and amino acids −27 to −1 of SEQ ID NO: 80 are a signal peptide. In another aspect, the mature polypeptide is amino acids 1 to 181 of SEQ ID NO: 81.

In one aspect, the mature polypeptide is amino acids 1 to 299 of SEQ ID NO: 83 and amino acids −42 to −1 of SEQ ID NO: 83 are a signal peptide. In another aspect, the mature polypeptide is amino acids 1 to 299 of SEQ ID NO: 84. In one aspect, the mature polypeptide is amino acids 1 to 307 of SEQ ID NO: 86 and amino acids −27 to −1 of SEQ ID NO: 86 are a signal peptide. In another aspect, the mature polypeptide is amino acids 1 to 307 of SEQ ID NO: 87.

In one aspect, the mature polypeptide is amino acids 1 to 203 of SEQ ID NO: 98 and amino acids −19 to −1 of SEQ ID NO: 98 are a signal peptide. In another aspect, the mature polypeptide is amino acids 1 to 203 of SEQ ID NO: 99.

In one aspect, the mature polypeptide is amino acids 1 to 337 of SEQ ID NO: 101 and amino acids −18 to −1 of SEQ ID NO: 101 are a signal peptide. In another aspect, the mature polypeptide is amino acids 1 to 337 of SEQ ID NO: 102.

In one aspect, the mature polypeptide is amino acids 1 to 302 of SEQ ID NO: 104 and amino acids −24 to −1 of SEQ ID NO: 104 are a signal peptide. In another aspect, the mature polypeptide is amino acids 1 to 302 of SEQ ID NO: 105.

In one aspect, the mature polypeptide is amino acids 1 to 464 of SEQ ID NO: 107 and amino acids −36 to −1 of SEQ ID NO: 107 are a signal peptide. In another aspect, the mature polypeptide is amino acids 1 to 464 of SEQ ID NO: 108. In one aspect, the mature polypeptide is amino acids 1 to 472 of SEQ ID NO: 110 and amino acids −27 to −1 of SEQ ID NO: 110 are a signal peptide. In another aspect, the mature polypeptide is amino acids 1 to 472 of SEQ ID NO: 111.

In one aspect, the mature polypeptide is amino acids 1 to 364 of SEQ ID NO: 113 and amino acids −18 to −1 of SEQ ID NO: 113 are a signal peptide. In another aspect, the mature polypeptide is amino acids 1 to 364 of SEQ ID NO: 114. In one aspect, the mature polypeptide is amino acids 1 to 372 of SEQ ID NO: 116 and amino acids −18 to −1 of SEQ ID NO: 116 are a signal peptide. In another aspect, the mature polypeptide is amino acids 1 to 372 of SEQ ID NO: 117.

In one aspect, the mature polypeptide is amino acids 1 to 357 of SEQ ID NO: 119 and amino acids −27 to −1 of SEQ ID NO: 119 are a signal peptide. In another aspect, the mature polypeptide is amino acids 1 to 357 of SEQ ID NO: 120.

In one aspect, the mature polypeptide is amino acids 1 to 302 of SEQ ID NO: 122 and amino acids −24 to −1 of SEQ ID NO: 122 are a signal peptide. In another aspect, the mature polypeptide is amino acids 1 to 302 of SEQ ID NO: 123.

In one aspect, the mature polypeptide is amino acids 1 to 453 of SEQ ID NO: 125 and amino acids −39 to −1 of SEQ ID NO: 125 are a signal peptide. In another aspect, the mature polypeptide is amino acids 1 to 453 of SEQ ID NO: 126. In one aspect, the mature polypeptide is amino acids 1 to 461 of SEQ ID NO: 128 and amino acids −27 to −1 of SEQ ID NO: 128 are a signal peptide. In another aspect, the mature polypeptide is amino acids 1 to 461 of SEQ ID NO: 129.

In one aspect, the mature polypeptide is amino acids 1 to 377 of SEQ ID NO: 131 and amino acids −20 to −1 of SEQ ID NO: 131 are a signal peptide. In another aspect, the mature polypeptide is amino acids 1 to 377 of SEQ ID NO: 132. In one aspect, the mature polypeptide is amino acids 1 to 385 of SEQ ID NO: 134 and amino acids −20 to −1 of SEQ ID NO: 134 are a signal peptide. In another aspect, the mature polypeptide is amino acids 1 to 385 of SEQ ID NO: 135.

In one aspect, the mature polypeptide is amino acids 1 to 309 of SEQ ID NO: 137 and amino acids −26 to −1 of SEQ ID NO: 137 are a signal peptide. In another aspect, the mature polypeptide is amino acids 1 to 309 of SEQ ID NO: 138.

In one aspect, the mature polypeptide is amino acids 1 to 304 of SEQ ID NO: 140 and amino acids −21 to −1 of SEQ ID NO: 140 are a signal peptide. In another aspect, the mature polypeptide is amino acids 1 to 304 of SEQ ID NO: 141. In one aspect, the mature polypeptide is amino acids 1 to 312 of SEQ ID NO: 143 and amino acids −21 to −1 of SEQ ID NO: 143 are a signal peptide. In another aspect, the mature polypeptide is amino acids 1 to 312 of SEQ ID NO: 144.

In one aspect, the mature polypeptide is amino acids 1 to 302 of SEQ ID NO: 146 and amino acids −26 to −1 of SEQ ID NO: 146 are a signal peptide. In another aspect, the mature polypeptide is amino acids 1 to 302 of SEQ ID NO: 147.

In one aspect, the mature polypeptide is amino acids 1 to 302 of SEQ ID NO: 149 and amino acids −23 to −1 of SEQ ID NO: 149 are a signal peptide. In another aspect, the mature polypeptide is amino acids 1 to 302 of SEQ ID NO: 150. In one aspect, the mature polypeptide is amino acids 1 to 310 of SEQ ID NO: 152 and amino acids −23 to −1 of SEQ ID NO: 152 are a signal peptide. In another aspect, the mature polypeptide is amino acids 1 to 310 of SEQ ID NO: 153.

In one aspect, the mature polypeptide is amino acids 1 to 316 of SEQ ID NO: 155 and amino acids −26 to −1 of SEQ ID NO: 155 are a signal peptide. In another aspect, the mature polypeptide is amino acids 1 to 316 of SEQ ID NO: 156.

In one aspect, the mature polypeptide is amino acids 1 to 316 of SEQ ID NO: 158 and amino acids −15 to −1 of SEQ ID NO: 158 are a signal peptide. In another aspect, the mature polypeptide is amino acids 1 to 316 of SEQ ID NO: 159.

In one aspect, the mature polypeptide is amino acids 1 to 303 of SEQ ID NO: 161 and amino acids −16 to −1 of SEQ ID NO: 161 are a signal peptide. In another aspect, the mature polypeptide is amino acids 1 to 303 of SEQ ID NO: 162.

In one aspect, the mature polypeptide is amino acids 1 to 361 of SEQ ID NO: 164 and amino acids −27 to −1 of SEQ ID NO: 164 are a signal peptide. In another aspect, the mature polypeptide is amino acids 1 to 361 of SEQ ID NO: 165.

In one aspect, the mature polypeptide is amino acids 1 to 373 of SEQ ID NO: 167 and amino acids −24 to −1 of SEQ ID NO: 167 are a signal peptide. In another aspect, the mature polypeptide is amino acids 1 to 373 of SEQ ID NO: 168.

In one aspect, the mature polypeptide is amino acids 1 to 302 of SEQ ID NO: 170 and amino acids −22 to −1 of SEQ ID NO: 170 are a signal peptide. In another aspect, the mature polypeptide is amino acids 1 to 302 of SEQ ID NO: 171.

In one aspect, the mature polypeptide is amino acids 1 to 364 of SEQ ID NO: 173 and amino acids −19 to −1 of SEQ ID NO: 173 are a signal peptide. In another aspect, the mature polypeptide is amino acids 1 to 364 of SEQ ID NO: 174.

In one aspect, the mature polypeptide is amino acids 1 to 323 of SEQ ID NO: 176 and amino acids −21 to −1 of SEQ ID NO: 176 are a signal peptide. In another aspect, the mature polypeptide is amino acids 1 to 323 of SEQ ID NO: 177. In one aspect, the mature polypeptide is amino acids 1 to 331 of SEQ ID NO: 179 and amino acids −21 to −1 of SEQ ID NO: 179 are a signal peptide. In another aspect, the mature polypeptide is amino acids 1 to 331 of SEQ ID NO: 180.

It is known in the art that a host cell may produce a mixture of two of more different mature polypeptides (i.e., with a different C-terminal and/or N-terminal amino acid) expressed by the same polynucleotide. It is also known in the art that different host cells process polypeptides differently, and thus, one host cell expressing a polynucleotide may produce a different mature polypeptide (e.g., having a different C-terminal and/or N-terminal amino acid) as compared to another host cell expressing the same polynucleotide.

Mature polypeptide coding sequence: The term "mature polypeptide coding sequence" means a polynucleotide that encodes a mature polypeptide having arabinofuranosidase or xylanase activity. In one aspect, the mature polypeptide coding sequence is nucleotides 79 to 987 of SEQ ID NO: 10; nucleotides 1 to 78 of SEQ ID NO: 10 encode a signal peptide.

In one aspect, the mature polypeptide coding sequence is the joined sequence of nucleotides 49 to 70 and nucleotides 123 to 1027 of SEQ ID NO: 25 or the cDNA sequence thereof; nucleotides 1 to 48 of SEQ ID NO: 25 encode a signal peptide.

In one aspect, the mature polypeptide coding sequence is nucleotides 88 to 993 of SEQ ID NO: 22; nucleotides 1 to 87 of SEQ ID NO: 22 encode a signal peptide.

In one aspect, the mature polypeptide coding sequence is nucleotides 109 to 1422 of SEQ ID NO: 28; nucleotides 1 to 108 of SEQ ID NO: 28 encode a signal peptide.

In one aspect, the mature polypeptide coding sequence is nucleotides 82 to 1419 of SEQ ID NO: 31; nucleotides 1 to 81 of SEQ ID NO: 31 encode a signal peptide.

In one aspect, the mature polypeptide coding sequence is nucleotides 109 to 1422 of SEQ ID NO: 34; nucleotides 1 to 108 of SEQ ID NO: 34 encode a signal peptide.

In one aspect, the mature polypeptide coding sequence is nucleotides 82 to 1419 of SEQ ID NO: 37; nucleotides 1 to 81 of SEQ ID NO: 37 encode a signal peptide.

In one aspect, the mature polypeptide coding sequence is nucleotides 76 to 981 of SEQ ID NO: 46; nucleotides 1 to 75 of SEQ ID NO: 46 encode a signal peptide.

In one aspect, the mature polypeptide coding sequence is nucleotides 76 to 1008 of SEQ ID NO: 49; nucleotides 1 to 75 of SEQ ID NO: 49 encode a signal peptide.

In one aspect, the mature polypeptide coding sequence is the joined sequence of nucleotides 73 to 318, nucleotides 470 to 1298 and nucleotides 1392 to 1408 of SEQ ID NO: 52; nucleotides 1 to 72 of SEQ ID NO: 52 encode a signal peptide.

In one aspect, the mature polypeptide coding sequence is the joined sequence of nucleotides 73 to 318, nucleotides 470 to 1298 and nucleotides 1392 to 1435 of SEQ ID NO: 55; nucleotides 1 to 72 of SEQ ID NO: 55 encode a signal peptide.

In one aspect, the mature polypeptide coding sequence is nucleotides 94 to 1401 of SEQ ID NO: 58; nucleotides 1 to 93 of SEQ ID NO: 58 encode a signal peptide.

In one aspect, the mature polypeptide coding sequence is nucleotides 82 to 1413 of SEQ ID NO: 61; nucleotides 1 to 81 of SEQ ID NO: 61 encode a signal peptide.

In one aspect, the mature polypeptide coding sequence is the joined sequence of nucleotides 58 to 330, nucleotides 403 to 655, nucleotides 795 to 948 and nucleotides 1100 to 1325 of SEQ ID NO: 64; nucleotides 1 to 57 of SEQ ID NO: 64 encode a signal peptide.

In one aspect, the mature polypeptide coding sequence is the joined sequence of nucleotides 58 to 330, nucleotides 403 to 655, nucleotides 795 to 948 and nucleotides 1100 to 1352 of SEQ ID NO: 67; nucleotides 1 to 57 of SEQ ID NO: 67 encode a signal peptide.

In one aspect, the mature polypeptide coding sequence is nucleotides 82 to 633 of SEQ ID NO: 76; nucleotides 1 to 81 of SEQ ID NO: 76 encode a signal peptide.

In one aspect, the mature polypeptide coding sequence is nucleotides 82 to 624 of SEQ ID NO: 79; nucleotides 1 to 81 of SEQ ID NO: 79 encode a signal peptide.

In one aspect, the mature polypeptide coding sequence is nucleotides 127 to 1023 of SEQ ID NO: 82; nucleotides 1 to 126 of SEQ ID NO: 82 encode a signal peptide.

In one aspect, the mature polypeptide coding sequence is nucleotides 82 to 1002 of SEQ ID NO: 85; nucleotides 1 to 81 of SEQ ID NO: 85 encode a signal peptide.

In one aspect, the mature polypeptide coding sequence is the joined sequence of nucleotides 58 to 269 and nucleotides 328 to 724 of SEQ ID NO: 97; nucleotides 1 to 57 of SEQ ID NO: 97 encode a signal peptide.

In one aspect, the mature polypeptide coding sequence is the joined sequence of nucleotides 55 to 71, nucleotides 121 to 524, nucleotides 594 to 1054 and nucleotides 1142 to 1270 of SEQ ID NO: 100; nucleotides 1 to 54 of SEQ ID NO: 100 encode a signal peptide.

In one aspect, the mature polypeptide coding sequence is nucleotides 73 to 978 of SEQ ID NO: 103; nucleotides 1 to 72 of SEQ ID NO: 103 encode a signal peptide.

In one aspect, the mature polypeptide coding sequence is nucleotides 109 to 1500 of SEQ ID NO: 106; nucleotides 1 to 108 of SEQ ID NO: 106 encode a signal peptide.

In one aspect, the mature polypeptide coding sequence is nucleotides 82 to 1497 of SEQ ID NO: 109; nucleotides 1 to 81 of SEQ ID NO: 109 encode a signal peptide.

In one aspect, the mature polypeptide coding sequence is nucleotides 55 to 1146 of SEQ ID NO: 112; nucleotides 1 to 54 of SEQ ID NO: 112 encode a signal peptide.

In one aspect, the mature polypeptide coding sequence is nucleotides 55 to 1170 of SEQ ID NO: 115; nucleotides 1 to 54 of SEQ ID NO: 115 encode a signal peptide.

In one aspect, the mature polypeptide coding sequence is the joined sequence of nucleotides 82 to 1135 and nucleotides 1226 to 1242 of SEQ ID NO: 118; nucleotides 1 to 81 of SEQ ID NO: 118 encode a signal peptide.

In one aspect, the mature polypeptide coding sequence is nucleotides 73 to 978 of SEQ ID NO: 121; nucleotides 1 to 72 of SEQ ID NO: 121 encode a signal peptide.

In one aspect, the mature polypeptide coding sequence is nucleotides 118 to 1476 of SEQ ID NO: 124; nucleotides 1 to 117 of SEQ ID NO: 124 encode a signal peptide.

In one aspect, the mature polypeptide coding sequence is nucleotides 82 to 1464 of SEQ ID NO: 127; nucleotides 1 to 81 of SEQ ID NO: 127 encode a signal peptide.

In one aspect, the mature polypeptide coding sequence is the joined sequence of nucleotides 61 to 93, nucleotides 152 to 162, nucleotides 216 to 262 and nucleotides 323 to 1362 of SEQ ID NO: 130; nucleotides 1 to 60 of SEQ ID NO: 130 encode a signal peptide.

In one aspect, the mature polypeptide coding sequence is the joined sequence of nucleotides 61 to 93, nucleotides 152 to 162, nucleotides 216 to 262 and nucleotides 323 to 1386 of SEQ ID NO: 133; nucleotides 1 to 60 of SEQ ID NO: 133 encode a signal peptide.

In one aspect, the mature polypeptide coding sequence is nucleotides 79 to 1005 of SEQ ID NO: 136; nucleotides 1 to 78 of SEQ ID NO: 136 encode a signal peptide.

In one aspect, the mature polypeptide coding sequence is the joined sequence of nucleotides 64 to 358 and nucleotides 512 to 1128 of SEQ ID NO: 139; nucleotides 1 to 63 of SEQ ID NO: 139 encode a signal peptide.

In one aspect, the mature polypeptide coding sequence is the joined sequence of nucleotides 64 to 358 and nucleotides 512 to 1152 of SEQ ID NO: 142; nucleotides 1 to 63 of SEQ ID NO: 142 encode a signal peptide.

In one aspect, the mature polypeptide coding sequence is nucleotides 79 to 984 of SEQ ID NO: 145; nucleotides 1 to 78 of SEQ ID NO: 145 encode a signal peptide.

In one aspect, the mature polypeptide coding sequence is nucleotides 70 to 975 of SEQ ID NO: 148; nucleotides 1 to 69 of SEQ ID NO: 148 encode a signal peptide.

In one aspect, the mature polypeptide coding sequence is nucleotides 70 to 999 of SEQ ID NO: 151; nucleotides 1 to 69 of SEQ ID NO: 151 encode a signal peptide.

In one aspect, the mature polypeptide coding sequence is nucleotides 79 to 1026 of SEQ ID NO: 154; nucleotides 1 to 78 of SEQ ID NO: 154 encode a signal peptide.

In one aspect, the mature polypeptide coding sequence is nucleotides 46 to 993 of SEQ ID NO: 157; nucleotides 1 to 45 of SEQ ID NO: 157 encode a signal peptide.

In one aspect, the mature polypeptide coding sequence is nucleotides 49 to 957 of SEQ ID NO: 160; nucleotides 1 to 48 of SEQ ID NO: 160 encode a signal peptide.

In one aspect, the mature polypeptide coding sequence is the joined sequence of nucleotides 82 to 1147 and nucleotides 1208 to 1224 of SEQ ID NO: 163; nucleotides 1 to 81 of SEQ ID NO: 163 encode a signal peptide.

In one aspect, the mature polypeptide coding sequence is the joined sequence of nucleotides 73 to 318, nucleotides 478 to 1333 and nucleotides 1396 to 1412 of SEQ ID NO: 166; nucleotides 1 to 72 of SEQ ID NO: 166 encode a signal peptide.

In one aspect, the mature polypeptide coding sequence is the joined sequence of nucleotides 67 to 95, nucleotides 229 to 469, nucleotides 435 to 940 and nucleotides 1052 to 1280 of SEQ ID NO: 169; nucleotides 1 to 66 of SEQ ID NO: 169 encode a signal peptide.

In one aspect, the mature polypeptide coding sequence is the joined sequence of nucleotides 58 to 1132 and nucleotides 1199 to 1215 of SEQ ID NO: 172; nucleotides 1 to 57 of SEQ ID NO: 172 encode a signal peptide.

In one aspect, the mature polypeptide coding sequence is the joined sequence of nucleotides 64 to 492, nucleotides 571 to 988 and nucleotides 1080 to 1201 of SEQ ID NO: 175; nucleotides 1 to 63 of SEQ ID NO: 175 encode a signal peptide.

In one aspect, the mature polypeptide coding sequence is the joined sequence of nucleotides 64 to 492, nucleotides 571 to 988 and nucleotides 1080 to 1225 of SEQ ID NO: 178; nucleotides 1 to 63 of SEQ ID NO: 178 encode a signal peptide.

Nucleic acid construct: The term "nucleic acid construct" means a nucleic acid molecule, either single- or double-stranded, which is isolated from a naturally occurring gene or is modified to contain segments of nucleic acids in a manner that would not otherwise exist in nature or which is synthetic, which comprises one or more control sequences.

Nutrient Digestibility: The term "nutrient digestibility" means the fraction of a nutrient that disappears from the gastro-intestinal tract or a specified segment of the gastro-intestinal tract, e.g. the small intestine. Nutrient digestibility may be measured as the difference between what is administered to the subject and what. comes out in the faeces of the subject, or between what is administered to the subject and what remains in the digesta on a specified segment of the gastro intestinal tract, e.g. the ileum.

Nutrient digestibility as used herein may be measured by the difference between the intake of a nutrient and the excreted nutrient by means of the total collection of excreta during a period of time; or with the use of an inert marker that is not absorbed by the animal, and allows the researcher calculating the amount of nutrient that disappeared in the entire gastro-intestinal tract or a segment of the gastro-intestinal tract. Such an inert marker may be titanium dioxide, chromic oxide or acid insoluble ash. Digestibility may be expressed as a percentage of the nutrient in the feed, or as mass units of digestible nutrient per mass units of nutrient in the feed. Nutrient digestibility as used herein encompasses starch digestibility, fat digestibility, protein digestibility, and amino acid digestibility.

Energy digestibility as used herein means the gross energy of the feed consumed minus the gross energy of the faeces or the gross energy of the feed consumed minus the gross energy of the remaining digesta on a specified segment of the gastro-intestinal tract of the animal, e.g. the ileum. Metabolizable energy as used herein refers to apparent metabolizable energy and means the gross energy of the feed consumed minus the gross energy contained in the faeces, urine, and gaseous products of digestion. Energy digestibility and metabolizable energy may be measured as the difference between the intake of gross energy and the gross energy excreted in the faeces or the digesta present in specified segment of the gastro-intestinal tract using the same methods to measure the digestibility of nutrients, with appropriate corrections for nitrogen excretion to calculate metabolizable energy of feed.

Operably linked: The term "operably linked" means a configuration in which a control sequence is placed at an appropriate position relative to the coding sequence of a polynucleotide such that the control sequence directs expression of the coding sequence.

Sequence Identity: The relatedness between two amino acid sequences or between two nucleotide sequences is described by the parameter "sequence identity".

For purposes of the present invention, the degree of sequence identity between two amino acid sequences is determined using the Needleman-Wunsch algorithm (Needleman and Wunsch, 1970, *J. Mol. Biol.* 48: 443-453) as implemented in the Needle program of the EMBOSS package (EMBOSS: The European Molecular Biology Open Software Suite, Rice et al., 2000, *Trends Genet.* 16: 276-277), preferably version 3.0.0 or later. Version 6.1.0 was used. The optional parameters used are gap open penalty of 10, gap extension penalty of 0.5, and the EBLOSUM62 (EMBOSS version of BLOSUM62) substitution matrix. The output of Needle labelled "longest identity" (obtained using the—nobrief option) is used as the percent identity and is calculated as follows:

(Identical Residues×100)/(Length of Alignment−
Total Number of Gaps in Alignment)

For purposes of the present invention, the degree of sequence identity between two deoxyribonucleotide sequences is determined using the Needleman-Wunsch algorithm (Needleman and Wunsch, 1970, supra) as implemented in the Needle program of the EMBOSS package (EMBOSS: The European Molecular Biology Open Software Suite, Rice et al., 2000, supra), preferably version 3.0.0 or later. Version 6.1.0 was used. The optional parameters used are gap open penalty of 10, gap extension penalty of 0.5, and the EDNAFULL (EMBOSS version of NCBI NUC4.4) substitution matrix. The output of Needle labelled "longest identity" (obtained using the—nobrief option) is used as the percent identity and is calculated as follows:

(Identical Deoxyribonucleotides×100)/(Length of Alignment−Total Number of Gaps in Alignment)

Solubilised xylose from defatted destarched maize (DFDSM): The term "solubilised xylose from defatted destarched maize (DFDSM)" means the total amount of xylose measured in the supernatant after incubation with an enzyme compared to the total amount of xylose present in the substrate before the incubation with the enzyme. As described herein, the enzyme solubilizes the xylan in the substrate to soluble fragments (polysaccharides). Since the xylose assay only measures xylose (the monosaccharide), the solubilised xylan needs to be hydrolysed by acid in order to release all of the xylose as monosaccharides before the xylose assay can be performed. The percentage solubilised xylose from defatted destarched maize (DFDSM) may be calculated as described in example 23 herein and is presented as 'Percent solubilised xylose' in the examples.

The term "solubilise at least x % xylose from defatted destarched maize (DFDSM)" means that the total amount of xylose measured in the supernatant after incubation as described above is at least x % The term "solubilise at least x times more xylose from DFDSM than the GH10 or GH11 polypeptide can when the GH62 polypeptide is not present" means that the total amount of xylose measured in the supernatant after incubation as described above is at least x times higher using the combination of a GH10 or GH11 xylanase and a GH62 arabinofuranosidase compared to when the GH10 or GH11 xylanase is used without the GH62 arabinofuranosidase being present.

Stringency conditions: The different stringency conditions are defined as follows.

The term "very low stringency conditions" means for probes of at least 100 nucleotides in length, prehybridization and hybridization at 42° C. in 5×SSPE, 0.3% SDS, 200 micrograms/ml sheared and denatured salmon sperm DNA, and 25% formamide, following standard Southern blotting procedures for 12 to 24 hours. The carrier material is finally washed three times each for 15 minutes using 2.0×SSC, 0.2% SDS at 60° C.

The term "low stringency conditions" means for probes of at least 100 nucleotides in length, prehybridization and hybridization at 42° C. in 5×SSPE, 0.3% SDS, 200 micrograms/ml sheared and denatured salmon sperm DNA, and 25% formamide, following standard Southern blotting procedures for 12 to 24 hours. The carrier material is finally washed three times each for 15 minutes using 1.0×SSC, 0.2% SDS at 60° C.

The term "medium stringency conditions" means for probes of at least 100 nucleotides in length, prehybridization and hybridization at 42° C. in 5×SSPE, 0.3% SDS, 200 micrograms/ml sheared and denatured salmon sperm DNA, and 35% formamide, following standard Southern blotting procedures for 12 to 24 hours. The carrier material is finally washed three times each for 15 minutes using 1.0×SSC, 0.2% SDS at 65° C.

The term "medium-high stringency conditions" means for probes of at least 100 nucleotides in length, prehybridization and hybridization at 42° C. in 5×SSPE, 0.3% SDS, 200 micrograms/ml sheared and denatured salmon sperm DNA, and 35% formamide, following standard Southern blotting procedures for 12 to 24 hours. The carrier material is finally washed three times each for 15 minutes using 1.0×SSC, 0.2% SDS at 70° C.

The term "high stringency conditions" means for probes of at least 100 nucleotides in length, prehybridization and hybridization at 42° C. in 5×SSPE, 0.3% SDS, 200 micrograms/ml sheared and denatured salmon sperm DNA, and 50% formamide, following standard Southern blotting procedures for 12 to 24 hours. The carrier material is finally washed three times each for 15 minutes using 0.5×SSC, 0.2% SDS at 70° C.

The term "very high stringency conditions" means for probes of at least 100 nucleotides in length, prehybridization and hybridization at 42° C. in 5×SSPE, 0.3% SDS, 200 micrograms/ml sheared and denatured salmon sperm DNA, and 50% formamide, following standard Southern blotting procedures for 12 to 24 hours. The carrier material is finally washed three times each for 15 minutes using 0.5×SSC, 0.2% SDS at 75° C.

Subsequence: The term "subsequence" means a polynucleotide having one or more (e.g., several) nucleotides absent from the 5' and/or 3' end of a mature polypeptide coding sequence; wherein the subsequence encodes a fragment having arabinofuranosidase or xylanase activity.

Substantially pure polypeptide: The term "substantially pure polypeptide" means a preparation that contains at most 10%, at most 8%, at most 6%, at most 5%, at most 4%, at most 3%, at most 2%, at most 1%, and at most 0.5% by weight of other polypeptide material with which it is natively or recombinantly associated. Preferably, the polypeptide is at least 92% pure, e.g., at least 94% pure, at least 95% pure, at least 96% pure, at least 97% pure, at least 98% pure, at least 99%, at least 99.5% pure, and 100% pure by weight of the total polypeptide material present in the preparation. The polypeptides of the present invention are preferably in a substantially pure form. This can be accomplished, for example, by preparing the polypeptide by well-known recombinant methods or by classical purification methods.

Variant: The term "variant" means a polypeptide having xylanase or arabinofuranosidase activity comprising an alteration, i.e., a substitution, insertion, and/or deletion of one or more (several) amino acid residues at one or more (several) positions. A substitution means a replacement of an amino acid occupying a position with a different amino acid; a deletion means removal of an amino acid occupying a position; and an insertion means adding 1-3 amino acids adjacent to an amino acid occupying a position.

Xylanase: The term "xylanase" means a 1,4-beta-D-xylan-xylohydrolase (E.C. 3.2.1.8) that catalyses the endohydrolysis of 1,4-beta-D-xylosidic linkages in xylans. Xylanase activity can be determined with 0.2% AZCL-arabinoxylan as substrate in 0.01% TRITON® X-100 and 200 mM sodium phosphate pH 6 at 37° C. One unit of xylanase activity is defined as 1.0 μmole of azurine produced per minute at 37° C., pH 6 from 0.2% AZCL-arabinoxylan as substrate in 200 mM sodium phosphate pH 6.

Nomenclature

For purposes of the present invention, the nomenclature [Y/F] means that the amino acid at this position may be a tyrosine (Try, Y) or a phenylalanine (Phe, F). Likewise the nomenclature [V/G/A/I] means that the amino acid at this position may be a valine (Val, V), glycine (Gly, G), alanine (Ala, A) or isoleucine (Ile, I), and so forth for other combinations as described herein. Unless otherwise limited further, the amino acid X is defined such that it may be any of the 20 natural amino acids.

DETAILED DESCRIPTION OF THE INVENTION

The inventors have found that certain arabinofuranosidases from glycoside hydrolase family 62 (herein referred to as GH62) in combination with one or more GH10 or GH11 xylanase are surprisingly good at solubilising the xylose backbone of sterically hindered arabinoxylan found in plant based material from the sub-family Panicoideae. This is surprising since arabinofuranosidases which are known to be very good at solubilising wheat arabinoxylan (e.g. the GH43 from *Humicola insolens* having SEQ ID NO: 1 of WO 2006/114095, the GH51 from *Meripilus giganteus* having SEQ ID NO: 2 of WO 2006/114095 or the combination of both) are unable to solubilise the highly substituted arabinoxylan found in e.g. maize, corn, sorghum, switchgrass, millet, pearl millet and foxtail millet.

The amount of starch present in untreated plant material makes it difficult to detect significant solubilisation of arabinoxylan. Thus model substrates, wherein the starch and fat present in the plant material is removed without effecting the degree of substitution, can be used to aid the determination of improved enzyme combinations over known prior art combinations. One model substrate is defatted destarched maize (DFDSM) and can be prepared as described in the experimental section herein. It is important that the model substrate is not prepared using strongly acidic or basic conditions or high temperatures, since such conditions can remove the side chain carbohydrate molecules and/or ester groups present on the xylan backbone. If these side chain groups are removed, then the complexity and degree of substitution will be reduced resulting in an arabinoxylan material which is easy to degrade by known solutions. It is for this reason that heat, acid and/or base pre-treatment is used in biomass conversion.

The solubilisation of the arabinoxylan can be measured as the amount of xylose released into the supernatant. Increased amounts of solubilisation will result in more xylose being released which can be detected using e.g. the xylose assay method as described herein. Without wishing to be bound by theory, it is believed that increasing the solubilisation of the arabinoxylan opens up the cell walls that can result in the nutrients, such as starch, which are trapped inside being released. The release of starch and other nutrients can result in improved animal performance and/or improved conversion of biomass to e.g. ethanol.

The arabinofuranosidases which have this surprising property all comprise the motif [H/Y][L/M]F[F/S][A/C/H/S/T/V][A/D/G/N/R]D[D/E/N]G (SEQ ID NO: 1). As far as the inventors are aware, this motif is only found in arabinofuranosidases from family GH62 and are present in the polypeptides of the invention.

Thus in a first aspect, the invention relates to a composition comprising one or more GH10 or GH11 polypeptides having xylanase activity and one or more GH62 polypeptides having arabinofuranosidase activity, wherein:
  (a) the GH62 polypeptide comprises the motif [H/Y][L/M]F[F/S][A/C/H/S/T/V][A/D/G/N/R]D[D/E/N]G (SEQ ID NO: 1);
  (b) the GH10 or GH11 polypeptide and the GH62 polypeptide together solubilise at least 2.0% xylose from defatted destarched maize (DFDSM); and
  (c) the GH10 or GH11 polypeptide and the GH62 polypeptide together solubilise at least 2 times more xylose from DFDSM than the GH10 or GH11 polypeptide can when the GH62 polypeptide is not present;
  wherein (b) and (c) are performed under the reaction conditions:
    i) 25 mg GH10 or GH11 polypeptide per kg DFDSM,
    ii) 12.5 mg GH62 polypeptide per kg DFDSM, and
    iii) incubation at 40° C., pH 5 for 4 hours.

In an alternative first aspect, the invention relates to a composition comprising one or more GH10 or GH11 polypeptides having xylanase activity and one or more GH62 polypeptides having arabinofuranosidase activity, wherein:
  (a) the GH62 polypeptide comprises the motif [H/Y][L/M]F[F/S][A/C/H/S/T/V][A/D/G/N/R]D[D/E/N]G (SEQ ID NO: 1);
  (b) the GH10 or GH11 polypeptide and the GH62 polypeptide together solubilise at least 2.0% xylose from defatted destarched maize (DFDSM); and
  (c) the GH10 or GH11 polypeptide and the GH62 polypeptide together solubilise at least 2 times more xylose from DFDSM than the GH10 or GH11 polypeptide can when the GH62 polypeptide is not present;
  wherein (b) and (c) are performed under the reaction conditions:
    i) 10 mg GH10 or GH11 polypeptide per kg DFDSM,
    ii) 10 mg GH62 polypeptide per kg DFDSM, and
    iii) incubation at 40° C., pH 5 for 4 hours.

In an embodiment, the amino acid in position 1 of the motif is a histidine or tyrosine. In an embodiment, the amino acid in position 2 of the motif is a leucine. In an embodiment, the amino acid in position 4 of the motif is a phenylalanine or serine. In an embodiment, the amino acid in position 5 of the motif is an alanine, serine or valine. In an embodiment, the amino acid in position 6 of the motif is an alanine, aspartic acid or glycine. In an embodiment, the amino acid in position 8 of the motif is an asparagine. In a preferred embodiment, the GH62 polypeptide comprises the motif [H/Y]LF[F/S][A/S/V][A/D/G]DNG (SEQ ID NO: 2).

In an embodiment, the amino acid in position 1 of the motif is a tyrosine. In an embodiment, the amino acid in position 2 of the motif is a leucine. In an embodiment, the amino acid in position 4 of the motif is a phenylalanine. In an embodiment, the amino acid in position 5 of the motif is an alanine, cysteine or valine, preferably an alanine or valine, more preferably an alanine. In an embodiment, the amino acid in position 6 of the motif is an alanine, aspartic acid or glycine, preferably an alanine or glycine, more preferably a glycine. In an embodiment, the amino acid in position 8 of the motif is an asparagine. In a preferred embodiment, the GH62 polypeptide comprises the motif YLFF[A/V][A/G]DNG (SEQ ID NO: 3), even more preferably the motif YLFFAGDNG (SEQ ID NO: 4).

In an embodiment, the amino acid in position 1 of the motif is a histidine or tyrosine, preferably a tyrosine. In an embodiment, the amino acid in position 2 of the motif is a leucine. In an embodiment, the amino acid in position 4 of the motif is a serine. In an embodiment, the amino acid in position 5 of the motif is a serine or threonine, preferably a serine. In an embodiment, the amino acid in position 6 of the motif is an aspartic acid or glycine, preferably an aspartic acid. In an embodiment, the amino acid in position 8 of the motif is an asparagine. In a preferred embodiment, the GH62 polypeptide comprises the motif [H/Y]LFSSDDNG (SEQ ID NO: 5), even more preferably the motif YLFSSDDNG (SEQ ID NO: 6).

In an alternative first aspect, the invention relates to an animal feed or animal feed additive comprising one or more GH10 or GH11 polypeptides having xylanase activity and one or more GH62 polypeptides having arabinofuranosidase activity, wherein:
  (a) the GH62 polypeptide comprises the motif [H/Y][L/M]F[F/S][A/C/H/S/T/V][A/D/G/N/R]D[D/E/N]G (SEQ ID NO: 1);
  (b) the GH10 or GH11 polypeptide and the GH62 polypeptide together solubilise at least 2.0% xylose from defatted destarched maize (DFDSM);
  (c) the GH10 or GH11 polypeptide and the GH62 polypeptide together solubilise at least 2 times more xylose from DFDSM than the GH10 or GH11 polypeptide can when the GH62 polypeptide is not present;
    wherein (b) and (c) are performed under the reaction conditions:
      i) 10 mg GH10 or GH11 polypeptide per kg DFDSM,
      ii) 10 mg GH62 polypeptide per kg DFDSM, and
      iii) incubation at 40° C., pH 5 for 4 hours;
  (d) the GH10 or GH11 polypeptide is dosed at 0.01-200 mg enzyme protein per kg animal feed; and
  (e) the GH62 polypeptide is dosed at 0.01-200 mg enzyme protein per kg animal feed.

The following data points were obtained demonstrating the generality of the invention.

8 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%.

In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of the mature polypeptide of SEQ ID NO: 8. In one embodiment, the polypeptide preferably comprises or consists of the amino acid sequence of SEQ ID NO: 8 or an allelic variant thereof; comprises the amino acid sequence of SEQ ID NO: 8 and a N-terminal and/or C-terminal His-tag and/or HQ-tag; or is a fragment thereof having arabinofuranosidase activity and having at least 90% of the length of the mature polypeptide. In another embodiment, the polypeptide comprises or consists of the mature polypeptide of SEQ ID NO: 8. In another embodiment, the polypeptide comprises or consists of amino acids 1 to 302 of SEQ ID NO: 8. In an embodiment, the polypeptide has been isolated.

In an embodiment, the composition comprises a GH62 polypeptide having arabinofuranosidase activity having a sequence identity to SEQ ID NO: 9 of at least 80%. In an embodiment, the GH62 polypeptide has a sequence identity

| | SEQ ID NO: 70 | SEQ ID NO: 71 | SEQ ID NO: 72 | SEQ ID NO: 73 | SEQ ID NO: 74 | SEQ ID NO: 75 | SEQ ID NO: 78 | SEQ ID NO: 81 | SEQ ID NO: 87 | SEQ ID NO: 88 | SEQ ID NO: 89 | SEQ ID NO: 95 | SEQ ID NO: 96 | SEQ ID NO: 99 | SEQ ID NO: 102 | SEQ ID NO: 180 |
|---|---|---|---|---|---|---|---|---|---|---|---|---|---|---|---|---|
| SEQ ID NO: 9 | X | | X | X | X | X | | X | X | X | X | | | | | |
| SEQ ID NO: 12 | | | | X | | X | | X | X | X | X | | | | | |
| SEQ ID NO: 15 | | | | X | | | X | | | | | | | | | |
| SEQ ID NO: 18 | | | | X | | | X | | | | | | | | | |
| SEQ ID NO: 21 | | X | | X | | | X | | | | | X | | | | |
| SEQ ID NO: 24 | X | X | X | X | X | X | | X | X | X | X | X | | X | X | X |
| SEQ ID NO: 27 | | | X | X | | | X | | X | X | X | | | | | |
| SEQ ID NO: 33 | | | | X | | | X | | | | X | | | | | |
| SEQ ID NO: 39 | | | | X | | | X | | | | | | | | | |
| SEQ ID NO: 45 | | | X | X | | | X | | | | | | | | | |
| SEQ ID NO: 51 | X | X | | X | X | X | X | X | X | X | X | | | | | |
| SEQ ID NO: 57 | | | X | X | | | X | | | | | | | | | |
| SEQ ID NO: 63 | | | X | | | | X | | | | | | | | | |
| SEQ ID NO: 69 | | | X | X | | | | | | | | | | | | |
| SEQ ID NO: 111 | X | | X | X | | | X | | | | | | | | | |
| SEQ ID NO: 117 | X | | X | X | | | X | | | | | | | | | |
| SEQ ID NO: 120 | X | | X | X | | | X | | | | | | | | | |
| SEQ ID NO: 129 | X | | X | X | | | X | | | | | | | | | |
| SEQ ID NO: 135 | X | | X | X | | | X | | | | | | | | | |
| SEQ ID NO: 138 | X | | X | X | | | X | | | | | | | | | |
| SEQ ID NO: 144 | X | | X | X | | | X | | | | | | | | | |
| SEQ ID NO: 147 | X | | X | X | | | X | | | | | | | | | |
| SEQ ID NO: 153 | | | X | X | | | X | | | | | | X | | | |
| SEQ ID NO: 156 | | | X | X | | | X | | | | | | X | | | |
| SEQ ID NO: 159 | | | X | X | | | X | | | | | | X | | | |
| SEQ ID NO: 162 | | | X | X | | | X | | | | | | X | | | |
| SEQ ID NO: 165 | | | X | X | | | X | | | | | | X | | | |
| SEQ ID NO: 168 | | | X | X | | | X | | | | | | X | | | |
| SEQ ID NO: 171 | | | X | X | | | X | | | | | | X | | | |
| SEQ ID NO: 174 | | | X | X | | | X | | | | | | X | | | |
| SEQ ID NO: 105 | | | X | X | | | X | | | | | | X | | | |
| SEQ ID NO: 123 | | | X | X | | | X | | | | | | X | | | |

GH62 Polypeptides of the Composition

Preferred embodiments of the first aspect of the invention relating to the GH62 polypeptide having arabinofuranosidase activity are disclosed herein below.

In an embodiment, the composition comprises a GH62 polypeptide having arabinofuranosidase activity, wherein GH62 polypeptide having arabinofuranosidase activity has a sequence identity to the mature polypeptide of SEQ ID NO: 8 of at least 80%, e.g., at least 85%, at least 86%, at least to SEQ ID NO: 9 of at least 85%. In an embodiment, the GH62 polypeptide has a sequence identity to SEQ ID NO: 9 of at least 86%. In an embodiment, the GH62 polypeptide has a sequence identity to SEQ ID NO: 9 of at least 87%. In an embodiment, the GH62 polypeptide has a sequence identity to SEQ ID NO: 9 of at least 88%. In an embodiment, the GH62 polypeptide has a sequence identity to SEQ ID NO: 9 of at least 89%. In an embodiment, the GH62 polypeptide has a sequence identity to SEQ ID NO: 9 of at least 90%. In an embodiment, the GH62 polypeptide has a sequence identity to SEQ ID NO: 9 of at least 91%. In an embodiment, the GH62 polypeptide has a sequence identity to SEQ ID NO: 9 of at least 92%. In an embodiment, the GH62 polypeptide has a sequence identity to SEQ ID NO: 9 of at least 93%. In an embodiment, the GH62 polypeptide has a sequence identity to SEQ ID NO: 9 of at least 94%. In an embodiment, the GH62 polypeptide has a sequence identity to SEQ ID NO: 9 of at least 95%. In an embodiment, the GH62 polypeptide has a sequence identity to SEQ ID NO: 9 of at least 96%. In an embodiment, the GH62 polypeptide has a sequence identity to SEQ ID NO: 9 of at least 97%. In an embodiment, the GH62 polypeptide has a sequence identity to SEQ ID NO: 9 of at least 98%. In an embodiment, the GH62 polypeptide has a sequence identity to SEQ ID NO: 9 of at least 99%.

In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of SEQ ID NO: 9. In one embodiment, the polypeptide preferably comprises or consists of the amino acid sequence of SEQ ID NO: 9 or an allelic variant thereof; comprises SEQ ID NO: 9 or an allelic variant thereof and a N-terminal and/or C-terminal His-tag and/or HQ-tag; or is a fragment thereof having arabinofuranosidase activity and having at least 90% of the length of SEQ ID NO: 9. In another embodiment, the polypeptide comprises or consists of amino acids 1 to 302 of SEQ ID NO: 9. In an embodiment, the polypeptide has been isolated.

In another embodiment, the composition comprises a GH62 polypeptide having arabinofuranosidase activity, wherein GH62 polypeptide having arabinofuranosidase activity has a sequence identity to the mature polypeptide of SEQ ID NO: 11 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%.

In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of the mature polypeptide of SEQ ID NO: 11. In one embodiment, the polypeptide preferably comprises or consists of the amino acid sequence of SEQ ID NO: 11 or an allelic variant thereof; comprises the amino acid sequence of SEQ ID NO: 11 and a N-terminal and/or C-terminal His-tag and/or HQ-tag; or is a fragment thereof having arabinofuranosidase activity and having at least 90% of the length of the mature polypeptide. In another embodiment, the polypeptide comprises or consists of the mature polypeptide of SEQ ID NO: 11. In another embodiment, the polypeptide comprises or consists of amino acids 1 to 303 of SEQ ID NO: 11. In an embodiment, the polypeptide has been isolated.

In an embodiment, the composition comprises a GH62 polypeptide having arabinofuranosidase activity having a sequence identity to SEQ ID NO: 12 of at least 80%. In an embodiment, the GH62 polypeptide has a sequence identity to SEQ ID NO: 12 of at least 85%. In an embodiment, the GH62 polypeptide has a sequence identity to SEQ ID NO: 12 of at least 86%. In an embodiment, the GH62 polypeptide has a sequence identity to SEQ ID NO: 12 of at least 87%. In an embodiment, the GH62 polypeptide has a sequence identity to SEQ ID NO: 12 of at least 88%. In an embodiment, the GH62 polypeptide has a sequence identity to SEQ ID NO: 12 of at least 89%. In an embodiment, the GH62 polypeptide has a sequence identity to SEQ ID NO: 12 of at least 90%. In an embodiment, the GH62 polypeptide has a sequence identity to SEQ ID NO: 12 of at least 91%. In an embodiment, the GH62 polypeptide has a sequence identity to SEQ ID NO: 12 of at least 92%. In an embodiment, the GH62 polypeptide has a sequence identity to SEQ ID NO: 12 of at least 93%. In an embodiment, the GH62 polypeptide has a sequence identity to SEQ ID NO: 12 of at least 94%. In an embodiment, the GH62 polypeptide has a sequence identity to SEQ ID NO: 12 of at least 95%. In an embodiment, the GH62 polypeptide has a sequence identity to SEQ ID NO: 12 of at least 96%. In an embodiment, the GH62 polypeptide has a sequence identity to SEQ ID NO: 12 of at least 97%. In an embodiment, the GH62 polypeptide has a sequence identity to SEQ ID NO: 12 of at least 98%. In an embodiment, the GH62 polypeptide has a sequence identity to SEQ ID NO: 12 of at least 99%.

In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of SEQ ID NO: 12. In one embodiment, the polypeptide preferably comprises or consists of the amino acid sequence of SEQ ID NO: 12 or an allelic variant thereof; comprises SEQ ID NO: 12 or an allelic variant thereof and a N-terminal and/or C-terminal His-tag and/or HQ-tag; or is a fragment thereof having arabinofuranosidase activity and having at least 90% of the length of SEQ ID NO: 12. In another embodiment, the polypeptide comprises or consists of amino acids 1 to 303 of SEQ ID NO: 12. In an embodiment, the polypeptide has been isolated.

In another embodiment, the composition comprises a GH62 polypeptide having arabinofuranosidase activity, wherein GH62 polypeptide having arabinofuranosidase activity has a sequence identity to the mature polypeptide of SEQ ID NO: 14 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%.

In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of the mature polypeptide of SEQ ID NO: 14. In one embodiment, the polypeptide preferably comprises or consists of the amino acid sequence of SEQ ID NO: 14 or an allelic variant thereof; comprises the amino acid sequence of SEQ ID NO: 14 and a N-terminal and/or C-terminal His-tag and/or HQ-tag; or is a fragment thereof having arabinofuranosidase activity and having at least 90% of the length of the mature polypeptide. In another embodiment, the polypeptide comprises or consists of the mature polypeptide of SEQ ID NO: 14. In another embodiment, the polypeptide comprises or consists of amino acids 1 to 382 of SEQ ID NO: 14. In an embodiment, the polypeptide has been isolated.

In an embodiment, the composition comprises a GH62 polypeptide having arabinofuranosidase activity having a sequence identity to SEQ ID NO: 15 of at least 80%. In an embodiment, the GH62 polypeptide has a sequence identity to SEQ ID NO: 15 of at least 85%. In an embodiment, the GH62 polypeptide has a sequence identity to SEQ ID NO: 15 of at least 86%. In an embodiment, the GH62 polypeptide has a sequence identity to SEQ ID NO: 15 of at least 87%. In an embodiment, the GH62 polypeptide has a sequence identity to SEQ ID NO: 15 of at least 88%. In an embodiment, the GH62 polypeptide has a sequence identity to SEQ ID NO: 15 of at least 89%. In an embodiment, the GH62 polypeptide has a sequence identity to SEQ ID NO: 15 of at least 90%. In an embodiment, the GH62 polypeptide has a sequence identity to SEQ ID NO: 15 of at least 91%. In an embodiment, the GH62 polypeptide has a sequence identity to SEQ ID NO: 15 of at least 92%. In an embodiment, the GH62 polypeptide has a sequence identity to SEQ ID NO: 15 of at least 93%. In an embodiment, the GH62 polypeptide has a sequence identity to SEQ ID NO: 15 of at least 94%. In an embodiment, the GH62 polypeptide has a sequence identity to SEQ ID NO: 15 of at least 95%. In an embodiment, the GH62 polypeptide has a sequence identity to SEQ ID NO: 15 of at least 96%. In an embodiment, the GH62 polypeptide has a sequence identity to SEQ ID NO: 15 of at least 97%. In an embodiment, the GH62 polypeptide has a sequence identity to SEQ ID NO: 15 of at least 98%. In an embodiment, the GH62 polypeptide has a sequence identity to SEQ ID NO: 15 of at least 99%.

In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of SEQ ID NO: 15. In one embodiment, the polypeptide preferably comprises or consists of the amino acid sequence of SEQ ID NO: 15 or an allelic variant thereof; comprises SEQ ID NO: 15 or an allelic variant thereof and a N-terminal and/or C-terminal His-tag and/or HQ-tag; or is a fragment thereof having arabinofuranosidase activity and having at least 90% of the length of SEQ ID NO: 15. In another embodiment, the polypeptide comprises or consists of amino acids 1 to 382 of SEQ ID NO: 15. In an embodiment, the polypeptide has been isolated.

In another embodiment, the composition comprises a GH62 polypeptide having arabinofuranosidase activity, wherein GH62 polypeptide having arabinofuranosidase activity has a sequence identity to the mature polypeptide of SEQ ID NO: 17 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%.

In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of the mature polypeptide of SEQ ID NO: 17. In one embodiment, the polypeptide preferably comprises or consists of the amino acid sequence of SEQ ID NO: 17 or an allelic variant thereof; comprises the amino acid sequence of SEQ ID NO: 17 and a N-terminal and/or C-terminal His-tag and/or HQ-tag; or is a fragment thereof having arabinofuranosidase activity and having at least 90% of the length of the mature polypeptide. In another embodiment, the polypeptide comprises or consists of the mature polypeptide of SEQ ID NO: 17. In another embodiment, the polypeptide comprises or consists of amino acids 1 to 378 of SEQ ID NO: 17. In an embodiment, the polypeptide has been isolated.

In an embodiment, the composition comprises a GH62 polypeptide having arabinofuranosidase activity having a sequence identity to SEQ ID NO: 18 of at least 80%. In an embodiment, the GH62 polypeptide has a sequence identity to SEQ ID NO: 18 of at least 85%. In an embodiment, the GH62 polypeptide has a sequence identity to SEQ ID NO: 18 of at least 86%. In an embodiment, the GH62 polypeptide has a sequence identity to SEQ ID NO: 18 of at least 87%. In an embodiment, the GH62 polypeptide has a sequence identity to SEQ ID NO: 18 of at least 88%. In an embodiment, the GH62 polypeptide has a sequence identity to SEQ ID NO: 18 of at least 89%. In an embodiment, the GH62 polypeptide has a sequence identity to SEQ ID NO: 18 of at least 90%. In an embodiment, the GH62 polypeptide has a sequence identity to SEQ ID NO: 18 of at least 91%. In an embodiment, the GH62 polypeptide has a sequence identity to SEQ ID NO: 18 of at least 92%. In an embodiment, the GH62 polypeptide has a sequence identity to SEQ ID NO: 18 of at least 93%. In an embodiment, the GH62 polypeptide has a sequence identity to SEQ ID NO: 18 of at least 94%. In an embodiment, the GH62 polypeptide has a sequence identity to SEQ ID NO: 18 of at least 95%. In an embodiment, the GH62 polypeptide has a sequence identity to SEQ ID NO: 18 of at least 96%. In an embodiment, the GH62 polypeptide has a sequence identity to SEQ ID NO: 18 of at least 97%. In an embodiment, the GH62 polypeptide has a sequence identity to SEQ ID NO: 18 of at least 98%. In an embodiment, the GH62 polypeptide has a sequence identity to SEQ ID NO: 18 of at least 99%.

In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of SEQ ID NO: 18. In one embodiment, the polypeptide preferably comprises or consists of the amino acid sequence of SEQ ID NO: 18 or an allelic variant thereof; comprises SEQ ID NO: 18 or an allelic variant thereof and a N-terminal and/or C-terminal His-tag and/or HQ-tag; or is a fragment thereof having arabinofuranosidase activity and having at least 90% of the length of SEQ ID NO: 18. In another embodiment, the polypeptide comprises or consists of amino acids 1 to 378 of SEQ ID NO: 18. In an embodiment, the polypeptide has been isolated.

In another embodiment, the composition comprises a GH62 polypeptide having arabinofuranosidase activity, wherein GH62 polypeptide having arabinofuranosidase activity has a sequence identity to the mature polypeptide of SEQ ID NO: 20 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%.

In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of the mature polypeptide of SEQ ID NO: 20. In one embodiment, the polypeptide preferably comprises or consists of the amino acid sequence of SEQ ID NO: 20 or an allelic variant thereof; comprises the amino acid sequence of SEQ ID NO: 20 and a N-terminal and/or C-terminal His-tag and/or HQ-tag; or is a fragment thereof having arabinofuranosidase activity and having at least 90% of the length of the mature polypeptide. In another embodiment, the polypeptide comprises or consists of the mature polypeptide of SEQ ID NO: 20. In another embodiment, the polypeptide comprises or consists of amino acids 1 to 311 of SEQ ID NO: 20. In an embodiment, the polypeptide has been isolated.

In an embodiment, the composition comprises a GH62 polypeptide having arabinofuranosidase activity having a sequence identity to SEQ ID NO: 21 of at least 80%. In an embodiment, the GH62 polypeptide has a sequence identity to SEQ ID NO: 21 of at least 85%. In an embodiment, the GH62 polypeptide has a sequence identity to SEQ ID NO: 21 of at least 86%. In an embodiment, the GH62 polypeptide has a sequence identity to SEQ ID NO: 21 of at least 87%. In an embodiment, the GH62 polypeptide has a sequence identity to SEQ ID NO: 21 of at least 88%. In an embodiment, the GH62 polypeptide has a sequence identity to SEQ ID NO: 21 of at least 89%. In an embodiment, the GH62 polypeptide has a sequence identity to SEQ ID NO: 21 of at least 90%. In an embodiment, the GH62 polypeptide has a sequence identity to SEQ ID NO: 21 of at least 91%. In an embodiment, the GH62 polypeptide has a sequence identity to SEQ ID NO: 21 of at least 92%. In an embodiment, the GH62 polypeptide has a sequence identity to SEQ ID NO: 21 of at least 93%. In an embodiment, the GH62 polypeptide has a sequence identity to SEQ ID NO: 21 of at least 94%. In an embodiment, the GH62 polypeptide has a sequence identity to SEQ ID NO: 21 of at least 95%. In an embodiment, the GH62 polypeptide has a sequence identity to SEQ ID NO: 21 of at least 96%. In an embodiment, the GH62 polypeptide has a sequence identity to SEQ ID NO: 21 of at least 97%. In an embodiment, the GH62 polypeptide has a sequence identity to SEQ ID NO: 21 of at least 98%. In an embodiment, the GH62 polypeptide has a sequence identity to SEQ ID NO: 21 of at least 99%.

In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of SEQ ID NO: 21. In one embodiment, the polypeptide preferably comprises or consists of the amino acid sequence of SEQ ID NO: 21 or an allelic variant thereof; comprises SEQ ID NO: 21 or an allelic variant thereof and a N-terminal and/or C-terminal His-tag and/or HQ-tag; or is a fragment thereof having arabinofuranosidase activity and having at least 90% of the length of SEQ ID NO: 21. In another embodiment, the polypeptide comprises or consists of amino acids 1 to 311 of SEQ ID NO: 21. In an embodiment, the polypeptide has been isolated.

In another embodiment, the composition comprises a GH62 polypeptide having arabinofuranosidase activity, wherein GH62 polypeptide having arabinofuranosidase activity has a sequence identity to the mature polypeptide of SEQ ID NO: 23 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%.

In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of the mature polypeptide of SEQ ID NO: 23. In one embodiment, the polypeptide preferably comprises or consists of the amino acid sequence of SEQ ID NO: 23 or an allelic variant thereof; comprises the amino acid sequence of SEQ ID NO: 23 and a N-terminal and/or C-terminal His-tag and/or HQ-tag; or is a fragment thereof having arabinofuranosidase activity and having at least 90% of the length of the mature polypeptide. In another embodiment, the polypeptide comprises or consists of the mature polypeptide of SEQ ID NO: 23. In another embodiment, the polypeptide comprises or consists of amino acids 1 to 302 of SEQ ID NO: 23. In an embodiment, the polypeptide has been isolated.

In an embodiment, the composition comprises a GH62 polypeptide having arabinofuranosidase activity having a sequence identity to SEQ ID NO: 24 of at least 80%. In an embodiment, the GH62 polypeptide has a sequence identity to SEQ ID NO: 24 of at least 85%. In an embodiment, the GH62 polypeptide has a sequence identity to SEQ ID NO: 24 of at least 86%. In an embodiment, the GH62 polypeptide has a sequence identity to SEQ ID NO: 24 of at least 87%. In an embodiment, the GH62 polypeptide has a sequence identity to SEQ ID NO: 24 of at least 88%. In an embodiment, the GH62 polypeptide has a sequence identity to SEQ ID NO: 24 of at least 89%. In an embodiment, the GH62 polypeptide has a sequence identity to SEQ ID NO: 24 of at least 90%. In an embodiment, the GH62 polypeptide has a sequence identity to SEQ ID NO: 24 of at least 91%. In an embodiment, the GH62 polypeptide has a sequence identity to SEQ ID NO: 24 of at least 92%. In an embodiment, the GH62 polypeptide has a sequence identity to SEQ ID NO: 24 of at least 93%. In an embodiment, the GH62 polypeptide has a sequence identity to SEQ ID NO: 24 of at least 94%. In an embodiment, the GH62 polypeptide has a sequence identity to SEQ ID NO: 24 of at least 95%. In an embodiment, the GH62 polypeptide has a sequence identity to SEQ ID NO: 24 of at least 96%. In an embodiment, the GH62 polypeptide has a sequence identity to SEQ ID NO: 24 of at least 97%. In an embodiment, the GH62 polypeptide has a sequence identity to SEQ ID NO: 24 of at least 98%. In an embodiment, the GH62 polypeptide has a sequence identity to SEQ ID NO: 24 of at least 99%.

In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of SEQ ID NO: 24. In one embodiment, the polypeptide preferably comprises or consists of the amino acid sequence of SEQ ID NO: 24 or an allelic variant thereof; comprises SEQ ID NO: 24 or an allelic variant thereof and a N-terminal and/or C-terminal His-tag and/or HQ-tag; or is a fragment thereof having arabinofuranosidase activity and having at least 90% of the length of SEQ ID NO: 24. In another embodiment, the polypeptide comprises or consists of amino acids 1 to 302 of SEQ ID NO: 24. In an embodiment, the polypeptide has been isolated.

In another embodiment, the composition comprises a GH62 polypeptide having arabinofuranosidase activity, wherein GH62 polypeptide having arabinofuranosidase activity has a sequence identity to the mature polypeptide of SEQ ID NO: 26 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%.

In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of the mature polypeptide of SEQ ID NO: 26. In one embodiment, the polypeptide preferably comprises or consists of the amino acid sequence of SEQ ID NO: 26 or an allelic variant thereof; comprises the amino acid sequence of SEQ ID NO: 26 and a N-terminal and/or C-terminal His-tag and/or HQ-tag; or is a fragment thereof having arabinofuranosidase activity and having at least 90% of the length of the mature polypeptide. In another embodiment, the polypeptide comprises or consists of the mature polypeptide of SEQ ID NO: 26. In another embodiment, the polypeptide comprises or consists of amino acids 1 to 309 of SEQ ID NO: 26. In an embodiment, the polypeptide has been isolated.

In an embodiment, the composition comprises a GH62 polypeptide having arabinofuranosidase activity having a sequence identity to SEQ ID NO: 27 of at least 80%. In an embodiment, the GH62 polypeptide has a sequence identity to SEQ ID NO: 27 of at least 85%.

In an embodiment, the GH62 polypeptide has a sequence identity to SEQ ID NO: 27 of at least 86%. In an embodiment, the GH62 polypeptide has a sequence identity to SEQ ID NO: 27 of at least 87%. In an embodiment, the GH62 polypeptide has a sequence identity to SEQ ID NO: 27 of at least 88%. In an embodiment, the GH62 polypeptide has a sequence identity to SEQ ID NO: 27 of at least 89%. In an embodiment, the GH62 polypeptide has a sequence identity to SEQ ID NO: 27 of at least 90%. In an embodiment, the GH62 polypeptide has a sequence identity to SEQ ID NO: 27 of at least 91%. In an embodiment, the GH62 polypeptide has a sequence identity to SEQ ID NO: 27 of at least 92%. In an embodiment, the GH62 polypeptide has a sequence identity to SEQ ID NO: 27 of at least 93%. In an embodiment, the GH62 polypeptide has a sequence identity to SEQ ID NO: 27 of at least 94%. In an embodiment, the GH62 polypeptide has a sequence identity to SEQ ID NO: 27 of at least 95%. In an embodiment, the GH62 polypeptide has a sequence identity to SEQ ID NO: 27 of at least 96%. In an embodiment, the GH62 polypeptide has a sequence identity to SEQ ID NO: 27 of at least 97%. In an embodiment, the GH62 polypeptide has a sequence identity to SEQ ID NO: 27 of at least 98%. In an embodiment, the GH62 polypeptide has a sequence identity to SEQ ID NO: 27 of at least 99%.

In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of SEQ ID NO: 27. In one embodiment, the polypeptide preferably comprises or consists of the amino acid sequence of SEQ ID NO: 27 or an allelic variant thereof; comprises SEQ ID NO: 27 or an allelic variant thereof and a N-terminal and/or C-terminal His-tag and/or HQ-tag; or is a fragment thereof having arabinofuranosidase activity and having at least 90% of the length of SEQ ID NO: 27. In another embodiment, the polypeptide comprises or consists of amino acids 1 to 309 of SEQ ID NO: 27. In an embodiment, the polypeptide has been isolated.

In another embodiment, the composition comprises a GH62 polypeptide having arabinofuranosidase activity, wherein GH62 polypeptide having arabinofuranosidase activity has a sequence identity to the mature polypeptide of SEQ ID NO: 29 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%.

In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of the mature polypeptide of SEQ ID NO: 29. In one embodiment, the polypeptide preferably comprises or consists of the amino acid sequence of SEQ ID NO: 29 or an allelic variant thereof; comprises the amino acid sequence of SEQ ID NO: 29 and a N-terminal and/or C-terminal His-tag and/or HQ-tag such as the mature polypeptide of SEQ ID NO: 32 or SEQ ID NO: 33; or is a fragment thereof having arabinofuranosidase activity and having at least 90% of the length of the mature polypeptide. In another embodiment, the polypeptide comprises or consists of the mature polypeptide of SEQ ID NO: 29. In another embodiment, the polypeptide comprises or consists of amino acids 1 to 438 of SEQ ID NO: 29. In another embodiment, the polypeptide comprises or consists of the mature polypeptide of SEQ ID NO: 32. In another embodiment, the polypeptide comprises or consists of amino acids 1 to 446 of SEQ ID NO: 32. In an embodiment, the polypeptide has been isolated.

In an embodiment, the composition comprises a GH62 polypeptide having arabinofuranosidase activity having a sequence identity to SEQ ID NO: 30 of at least 80%. In an embodiment, the GH62 polypeptide has a sequence identity to SEQ ID NO: 30 of at least 85%. In an embodiment, the GH62 polypeptide has a sequence identity to SEQ ID NO: 30 of at least 86%. In an embodiment, the GH62 polypeptide has a sequence identity to SEQ ID NO: 30 of at least 87%. In an embodiment, the GH62 polypeptide has a sequence identity to SEQ ID NO: 30 of at least 88%. In an embodiment, the GH62 polypeptide has a sequence identity to SEQ ID NO: 30 of at least 89%. In an embodiment, the GH62 polypeptide has a sequence identity to SEQ ID NO: 30 of at least 90%. In an embodiment, the GH62 polypeptide has a sequence identity to SEQ ID NO: 30 of at least 91%. In an embodiment, the GH62 polypeptide has a sequence identity to SEQ ID NO: 30 of at least 92%. In an embodiment, the GH62 polypeptide has a sequence identity to SEQ ID NO: 30 of at least 93%. In an embodiment, the GH62 polypeptide has a sequence identity to SEQ ID NO: 30 of at least 94%. In an embodiment, the GH62 polypeptide has a sequence identity to SEQ ID NO: 30 of at least 95%. In an embodiment, the GH62 polypeptide has a sequence identity to SEQ ID NO: 30 of at least 96%. In an embodiment, the GH62 polypeptide has a sequence identity to SEQ ID NO: 30 of at least 97%. In an embodiment, the GH62 polypeptide has a sequence identity to SEQ ID NO: 30 of at least 98%. In an embodiment, the GH62 polypeptide has a sequence identity to SEQ ID NO: 30 of at least 99%.

In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of SEQ ID NO: 30. In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of SEQ ID NO: 33. In one embodiment, the polypeptide preferably comprises or consists of the amino acid sequence of SEQ ID NO: 30 or an allelic variant thereof; comprises SEQ ID NO: 30 or an allelic variant thereof and a N-terminal and/or C-terminal His-tag and/or HQ-tag such as SEQ ID NO: 33; or is a fragment thereof having arabinofuranosidase activity and having at least 90% of the length of SEQ ID NO: 30. In another embodiment, the polypeptide comprises or consists of amino acids 1 to 438 of SEQ ID NO: 30. In another embodiment, the polypeptide comprises or consists of amino acids 1 to 446 of SEQ ID NO: 33. In an embodiment, the polypeptide has been isolated.

In another embodiment, the composition comprises a GH62 polypeptide having arabinofuranosidase activity, wherein GH62 polypeptide having arabinofuranosidase activity has a sequence identity to the mature polypeptide of SEQ ID NO: 35 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%.

In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of the mature polypeptide of SEQ ID NO: 35. In one embodiment, the polypeptide preferably comprises or consists of the amino acid sequence of SEQ ID NO: 35 or an allelic variant thereof; comprises the amino acid sequence of SEQ ID NO: 35 and a N-terminal and/or C-terminal His-tag and/or HQ-tag such as the mature polypeptide of SEQ ID NO: 38 or SEQ ID NO: 39; or is a fragment thereof having arabinofuranosidase activity and having at least 90% of the length of the mature polypeptide. In another embodiment, the polypeptide comprises or consists of the mature polypeptide of SEQ ID NO: 35. In another embodiment, the polypeptide comprises or consists of amino acids 1 to 438 of SEQ ID NO: 35. In another embodiment, the polypeptide comprises or consists of the mature polypeptide of SEQ ID NO: 38. In another embodiment, the polypeptide comprises or consists of amino acids 1 to 446 of SEQ ID NO: 38. In an embodiment, the polypeptide has been isolated.

In an embodiment, the composition comprises a GH62 polypeptide having arabinofuranosidase activity having a sequence identity to SEQ ID NO: 36 of at least 80%. In an embodiment, the GH62 polypeptide has a sequence identity to SEQ ID NO: 36 of at least 85%. In an embodiment, the GH62 polypeptide has a sequence identity to SEQ ID NO: 36 of at least 86%. In an embodiment, the GH62 polypeptide has a sequence identity to SEQ ID NO: 36 of at least 87%. In an embodiment, the GH62 polypeptide has a sequence identity to SEQ ID NO: 36 of at least 88%. In an embodiment, the GH62 polypeptide has a sequence identity to SEQ ID NO: 36 of at least 89%. In an embodiment, the GH62 polypeptide has a sequence identity to SEQ ID NO: 36 of at least 90%. In an embodiment, the GH62 polypeptide has a sequence identity to SEQ ID NO: 36 of at least 91%. In an embodiment, the GH62 polypeptide has a sequence identity to SEQ ID NO: 36 of at least 92%. In an embodiment, the GH62 polypeptide has a sequence identity to SEQ ID NO: 36 of at least 93%. In an embodiment, the GH62 polypeptide has a sequence identity to SEQ ID NO: 36 of at least 94%. In an embodiment, the GH62 polypeptide has a sequence identity to SEQ ID NO: 36 of at least 95%. In an embodiment, the GH62 polypeptide has a sequence identity to SEQ ID NO: 36 of at least 96%. In an embodiment, the GH62 polypeptide has a sequence identity to SEQ ID NO: 36 of at least 97%. In an embodiment, the GH62 polypeptide has a sequence identity to SEQ ID NO: 36 of at least 98%. In an embodiment, the GH62 polypeptide has a sequence identity to SEQ ID NO: 36 of at least 99%.

In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of SEQ ID NO: 36. In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of SEQ ID NO: 39. In one embodiment, the polypeptide preferably comprises or consists of the amino acid sequence of SEQ ID NO: 36 or an allelic variant thereof; comprises SEQ ID NO: 36 or an allelic variant thereof and a N-terminal and/or C-terminal His-tag and/or HQ-tag such as SEQ ID NO: 39; or is a fragment thereof having arabinofuranosidase activity and having at least 90% of the length of SEQ ID NO: 36. In another embodiment, the polypeptide comprises or consists of amino acids 1 to 438 of SEQ ID NO: 36. In another embodiment, the polypeptide comprises or consists of amino acids 1 to 446 of SEQ ID NO: 39. In an embodiment, the polypeptide has been isolated.

In another embodiment, the composition comprises a GH62 polypeptide having arabinofuranosidase activity, wherein GH62 polypeptide having arabinofuranosidase activity has a sequence identity to the mature polypeptide of SEQ ID NO: 41 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%.

In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of the mature polypeptide of SEQ ID NO: 41. In one embodiment, the polypeptide preferably comprises or consists of the amino acid sequence of SEQ ID NO: 41 or an allelic variant thereof; comprises the amino acid sequence of SEQ ID NO: 41 and a N-terminal and/or C-terminal His-tag and/or HQ-tag such as the mature polypeptide of SEQ ID NO: 44 or SEQ ID NO: 45; or is a fragment thereof having arabinofuranosidase activity and having at least 90% of the length of the mature polypeptide. In another embodiment, the polypeptide comprises or consists of the mature polypeptide of SEQ ID NO: 41. In another embodiment, the polypeptide comprises or consists of amino acids 1 to 318 of SEQ ID NO: 41. In another embodiment, the polypeptide comprises or consists of the mature polypeptide of SEQ ID NO: 44. In another embodiment, the polypeptide comprises or consists of amino acids 1 to 326 of SEQ ID NO: 44. In an embodiment, the polypeptide has been isolated.

In an embodiment, the composition comprises a GH62 polypeptide having arabinofuranosidase activity having a sequence identity to SEQ ID NO: 42 of at least 80%. In an embodiment, the GH62 polypeptide has a sequence identity to SEQ ID NO: 42 of at least 85%. In an embodiment, the GH62 polypeptide has a sequence identity to SEQ ID NO: 42 of at least 86%. In an embodiment, the GH62 polypeptide has a sequence identity to SEQ ID NO: 42 of at least 87%. In an embodiment, the GH62 polypeptide has a sequence identity to SEQ ID NO: 42 of at least 88%. In an embodiment, the GH62 polypeptide has a sequence identity to SEQ ID NO: 42 of at least 89%. In an embodiment, the GH62 polypeptide has a sequence identity to SEQ ID NO: 42 of at least 90%. In an embodiment, the GH62 polypeptide has a sequence identity to SEQ ID NO: 42 of at least 91%. In an embodiment, the GH62 polypeptide has a sequence identity to SEQ ID NO: 42 of at least 92%. In an embodiment, the GH62 polypeptide has a sequence identity to SEQ ID NO: 42 of at least 93%. In an embodiment, the GH62 polypeptide has a sequence identity to SEQ ID NO: 42 of at least 94%. In an embodiment, the GH62 polypeptide has a sequence identity to SEQ ID NO: 42 of at least 95%. In an embodiment, the GH62 polypeptide has a sequence identity to SEQ ID NO: 42 of at least 96%. In an embodiment, the GH62 polypeptide has a sequence identity to SEQ ID NO: 42 of at least 97%. In an embodiment, the GH62 polypeptide has a sequence identity to SEQ ID NO: 42 of at least 98%. In an embodiment, the GH62 polypeptide has a sequence identity to SEQ ID NO: 42 of at least 99%.

In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of SEQ ID NO: 42. In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of SEQ ID NO: 45. In one embodiment, the polypeptide preferably comprises or consists of the amino acid sequence of SEQ ID NO: 42 or an allelic variant thereof; comprises SEQ ID NO: 42 or an allelic variant thereof and a N-terminal and/or C-terminal His-tag and/or HQ-tag such as SEQ ID NO: 45; or is a fragment thereof having arabinofuranosidase activity and having at least 90% of the length of SEQ ID NO: 42. In another embodiment, the polypeptide comprises or consists of amino acids 1 to 318 of SEQ ID NO: 42. In another embodiment, the polypeptide comprises or consists of amino acids 1 to 326 of SEQ ID NO: 45. In an embodiment, the polypeptide has been isolated.

In another embodiment, the composition comprises a GH62 polypeptide having arabinofuranosidase activity, wherein GH62 polypeptide having arabinofuranosidase activity has a sequence identity to the mature polypeptide of SEQ ID NO: 47 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%.

In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of the mature polypeptide of SEQ ID NO: 47. In one embodiment, the polypeptide preferably comprises or consists of the amino acid sequence of SEQ ID NO: 47 or an allelic variant thereof; comprises the amino acid sequence of SEQ ID NO: 47 and a N-terminal and/or C-terminal His-tag and/or HQ-tag such as the mature polypeptide of SEQ ID NO: 50 or SEQ ID NO: 51; or is a fragment thereof having arabinofuranosidase activity and having at least 90% of the length of the mature polypeptide. In another embodiment, the polypeptide comprises or consists of the mature polypeptide of SEQ ID NO: 47. In another embodiment, the polypeptide comprises or consists of amino acids 1 to 302 of SEQ ID NO: 47. In another embodiment, the polypeptide comprises or consists of the mature polypeptide of SEQ ID NO: 50. In another embodiment, the polypeptide comprises or consists of amino acids 1 to 311 of SEQ ID NO: 50. In an embodiment, the polypeptide has been isolated.

In an embodiment, the composition comprises a GH62 polypeptide having arabinofuranosidase activity having a sequence identity to SEQ ID NO: 48 of at least 80%. In an embodiment, the GH62 polypeptide has a sequence identity to SEQ ID NO: 48 of at least 85%. In an embodiment, the GH62 polypeptide has a sequence identity to SEQ ID NO: 48 of at least 86%. In an embodiment, the GH62 polypeptide has a sequence identity to SEQ ID NO: 48 of at least 87%. In an embodiment, the GH62 polypeptide has a sequence identity to SEQ ID NO: 48 of at least 88%. In an embodiment, the GH62 polypeptide has a sequence identity to SEQ ID NO: 48 of at least 89%. In an embodiment, the GH62 polypeptide has a sequence identity to SEQ ID NO: 48 of at least 90%. In an embodiment, the GH62 polypeptide has a sequence identity to SEQ ID NO: 48 of at least 91%. In an embodiment, the GH62 polypeptide has a sequence identity to SEQ ID NO: 48 of at least 92%. In an embodiment, the GH62 polypeptide has a sequence identity to SEQ ID NO: 48 of at least 93%. In an embodiment, the GH62 polypeptide has a sequence identity to SEQ ID NO: 48 of at least 94%. In an embodiment, the GH62 polypeptide has a sequence identity to SEQ ID NO: 48 of at least 95%. In an embodiment, the GH62 polypeptide has a sequence identity to SEQ ID NO: 48 of at least 96%. In an embodiment, the GH62 polypeptide has a sequence identity to SEQ ID NO: 48 of at least 97%. In an embodiment, the GH62 polypeptide has a sequence identity to SEQ ID NO: 48 of at least 98%. In an embodiment, the GH62 polypeptide has a sequence identity to SEQ ID NO: 48 of at least 99%.

In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of SEQ ID NO: 48. In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of SEQ ID NO: 51. In one embodiment, the polypeptide preferably comprises or consists of the amino acid sequence of SEQ ID NO: 48 or an allelic variant thereof; comprises SEQ ID NO: 48 or an allelic variant thereof and a N-terminal and/or C-terminal His-tag and/or HQ-tag such as SEQ ID NO: 51; or is a fragment thereof having arabinofuranosidase activity and having at least 90% of the length of SEQ ID NO: 48. In another embodiment, the polypeptide comprises or consists of amino acids 1 to 302 of SEQ ID NO: 48. In another embodiment, the polypeptide comprises or consists of amino acids 1 to 311 of SEQ ID NO: 51. In an embodiment, the polypeptide has been isolated.

In another embodiment, the composition comprises a GH62 polypeptide having arabinofuranosidase activity, wherein GH62 polypeptide having arabinofuranosidase activity has a sequence identity to the mature polypeptide of SEQ ID NO: 53 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%.

In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of the mature polypeptide of SEQ ID NO: 53. In one embodiment, the polypeptide preferably comprises or consists of the amino acid sequence of SEQ ID NO: 53 or an allelic variant thereof; comprises the amino acid sequence of SEQ ID NO: 53 and a N-terminal and/or C-terminal His-tag and/or HQ-tag such as the mature polypeptide of SEQ ID NO: 56 or SEQ ID NO: 57; or is a fragment thereof having arabinofuranosidase activity and having at least 90% of the length of the mature polypeptide. In another embodiment, the polypeptide comprises or consists of the mature polypeptide of SEQ ID NO: 53. In another embodiment, the polypeptide comprises or consists of amino acids 1 to 364 of SEQ ID NO: 53. In another embodiment, the polypeptide comprises or consists of the mature polypeptide of SEQ ID NO: 56. In another embodiment, the polypeptide comprises or consists of amino acids 1 to 373 of SEQ ID NO: 56. In an embodiment, the polypeptide has been isolated.

In an embodiment, the composition comprises a GH62 polypeptide having arabinofuranosidase activity having a sequence identity to SEQ ID NO: 54 of at least 80%. In an embodiment, the GH62 polypeptide has a sequence identity to SEQ ID NO: 54 of at least 85%. In an embodiment, the GH62 polypeptide has a sequence identity to SEQ ID NO: 54 of at least 86%. In an embodiment, the GH62 polypeptide has a sequence identity to SEQ ID NO: 54 of at least 87%. In an embodiment, the GH62 polypeptide has a sequence identity to SEQ ID NO: 54 of at least 88%. In an embodiment, the GH62 polypeptide has a sequence identity to SEQ ID NO: 54 of at least 89%. In an embodiment, the GH62 polypeptide has a sequence identity to SEQ ID NO: 54 of at least 90%. In an embodiment, the GH62 polypeptide has a sequence identity to SEQ ID NO: 54 of at least 91%. In an embodiment, the GH62 polypeptide has a sequence identity to SEQ ID NO: 54 of at least 92%. In an embodiment, the GH62 polypeptide has a sequence identity to SEQ ID NO: 54 of at least 93%. In an embodiment, the GH62 polypeptide has a sequence identity to SEQ ID NO: 54 of at least 94%. In an embodiment, the GH62 polypeptide has a sequence identity to SEQ ID NO: 54 of at least 95%. In an embodiment, the GH62 polypeptide has a sequence identity to SEQ ID NO: 54 of at least 96%. In an embodiment, the GH62 polypeptide has a sequence identity to SEQ ID NO: 54 of at least 97%. In an embodiment, the GH62 polypeptide has a sequence identity to SEQ ID NO: 54 of at least 98%. In an embodiment, the GH62 polypeptide has a sequence identity to SEQ ID NO: 54 of at least 99%.

In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of SEQ ID NO: 54. In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of SEQ ID NO: 57. In one embodiment, the polypeptide preferably comprises or consists of the amino acid sequence of SEQ ID NO: 54 or an allelic variant thereof; comprises SEQ ID NO: 54 or an allelic variant thereof and a N-terminal and/or C-terminal His-tag and/or HQ-tag such as SEQ ID NO: 57; or is a fragment thereof having arabinofuranosidase activity and having at least 90% of the length of SEQ ID NO: 54. In another embodiment, the polypeptide comprises or consists of amino acids 1 to 364 of SEQ ID NO: 54. In another embodiment, the polypeptide comprises or consists of amino acids 1 to 373 of SEQ ID NO: 57. In an embodiment, the polypeptide has been isolated.

In another embodiment, the composition comprises a GH62 polypeptide having arabinofuranosidase activity, wherein GH62 polypeptide having arabinofuranosidase activity has a sequence identity to the mature polypeptide of SEQ ID NO: 59 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%.

In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of the mature polypeptide of SEQ ID NO: 59. In one embodiment, the polypeptide preferably comprises or consists of the amino acid sequence of SEQ ID NO: 65 or an allelic variant thereof; comprises the amino acid sequence of SEQ ID NO: 59 and a N-terminal and/or C-terminal His-tag and/or HQ-tag such as the mature polypeptide of SEQ ID NO: 62 or SEQ ID NO: 63; or is a fragment thereof having arabinofuranosidase activity and having at least 90% of the length of the mature polypeptide. In another embodiment, the polypeptide comprises or consists of the mature polypeptide of SEQ ID NO: 59. In another embodiment, the polypeptide comprises or consists of amino acids 1 to 436 of SEQ ID NO: 59. In another embodiment, the polypeptide comprises or consists of the mature polypeptide of SEQ ID NO: 62. In another embodiment, the polypeptide comprises or consists of amino acids 1 to 444 of SEQ ID NO: 62. In an embodiment, the polypeptide has been isolated.

In an embodiment, the composition comprises a GH62 polypeptide having arabinofuranosidase activity having a sequence identity to SEQ ID NO: 60 of at least 80%. In an embodiment, the GH62 polypeptide has a sequence identity to SEQ ID NO: 60 of at least 85%. In an embodiment, the GH62 polypeptide has a sequence identity to SEQ ID NO: 60 of at least 86%. In an embodiment, the GH62 polypeptide has a sequence identity to SEQ ID NO: 60 of at least 87%. In an embodiment, the GH62 polypeptide has a sequence identity to SEQ ID NO: 60 of at least 88%. In an embodiment, the GH62 polypeptide has a sequence identity to SEQ ID NO: 60 of at least 89%. In an embodiment, the GH62 polypeptide has a sequence identity to SEQ ID NO: 60 of at least 90%. In an embodiment, the GH62 polypeptide has a sequence identity to SEQ ID NO: 60 of at least 91%. In an embodiment, the GH62 polypeptide has a sequence identity to SEQ ID NO: 60 of at least 92%. In an embodiment, the GH62 polypeptide has a sequence identity to SEQ ID NO: 60 of at least 93%. In an embodiment, the GH62 polypeptide has a sequence identity to SEQ ID NO: 60 of at least 94%. In an embodiment, the GH62 polypeptide has a sequence identity to SEQ ID NO: 60 of at least 95%. In an embodiment, the GH62 polypeptide has a sequence identity to SEQ ID NO: 60 of at least 96%. In an embodiment, the GH62 polypeptide has a sequence identity to SEQ ID NO: 60 of at least 97%. In an embodiment, the GH62 polypeptide has a sequence identity to SEQ ID NO: 60 of at least 98%. In an embodiment, the GH62 polypeptide has a sequence identity to SEQ ID NO: 60 of at least 99%.

In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of SEQ ID NO: 60. In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of SEQ ID NO: 63. In one embodiment, the polypeptide preferably comprises or consists of the amino acid sequence of SEQ ID NO: 60 or an allelic variant thereof; comprises SEQ ID NO: 60 or an allelic variant thereof and a N-terminal and/or C-terminal His-tag and/or HQ-tag such as SEQ ID NO: 63; or is a fragment thereof having arabinofuranosidase activity and having at least 90% of the length of SEQ ID NO: 60. In another embodiment, the polypeptide comprises or consists of amino acids 1 to 436 of SEQ ID NO: 60. In another embodiment, the polypeptide comprises or consists of amino acids 1 to 444 of SEQ ID NO: 63. In an embodiment, the polypeptide has been isolated.

In another embodiment, the composition comprises a GH62 polypeptide having arabinofuranosidase activity, wherein GH62 polypeptide having arabinofuranosidase activity has a sequence identity to the mature polypeptide of SEQ ID NO: 65 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%.

In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of the mature polypeptide of SEQ ID NO: 65. In one embodiment, the polypeptide preferably comprises or consists of the amino acid sequence of SEQ ID NO: 65 or an allelic variant thereof; comprises the amino acid sequence of SEQ ID NO: 65 and a N-terminal and/or C-terminal His-tag and/or HQ-tag such as the mature polypeptide of SEQ ID NO: 68 or SEQ ID NO: 69; or is a fragment thereof having arabinofuranosidase activity and having at least 90% of the length of the mature polypeptide. In another embodiment, the polypeptide comprises or consists of the mature polypeptide of SEQ ID NO: 65. In another embodiment, the polypeptide comprises or consists of amino acids 1 to 302 of SEQ ID NO: 65. In another embodiment, the polypeptide comprises or consists of the mature polypeptide of SEQ ID NO: 68. In another embodiment, the polypeptide comprises or consists of amino acids 1 to 311 of SEQ ID NO: 68. In an embodiment, the polypeptide has been isolated.

In an embodiment, the composition comprises a GH62 polypeptide having arabinofuranosidase activity having a sequence identity to SEQ ID NO: 66 of at least 80%. In an embodiment, the GH62 polypeptide has a sequence identity to SEQ ID NO: 66 of at least 85%. In an embodiment, the GH62 polypeptide has a sequence identity to SEQ ID NO: 66 of at least 86%. In an embodiment, the GH62 polypeptide has a sequence identity to SEQ ID NO: 66 of at least 87%. In an embodiment, the GH62 polypeptide has a sequence identity to SEQ ID NO: 66 of at least 88%. In an embodiment, the GH62 polypeptide has a sequence identity to SEQ ID NO: 66 of at least 89%. In an embodiment, the GH62 polypeptide has a sequence identity to SEQ ID NO: 66 of at least 90%. In an embodiment, the GH62 polypeptide has a sequence identity to SEQ ID NO: 66 of at least 91%. In an embodiment, the GH62 polypeptide has a sequence identity to SEQ ID NO: 66 of at least 92%. In an embodiment, the GH62 polypeptide has a sequence identity to SEQ ID NO: 66 of at least 93%. In an embodiment, the GH62 polypeptide has a sequence identity to SEQ ID NO: 66 of at least 94%. In an embodiment, the GH62 polypeptide has a sequence identity to SEQ ID NO: 66 of at least 95%. In an embodiment, the GH62 polypeptide has a sequence identity to SEQ ID NO: 66 of at least 96%. In an embodiment, the GH62 polypeptide has a sequence identity to SEQ ID NO: 66 of at least 97%. In an embodiment, the GH62 polypeptide has a sequence identity to SEQ ID NO: 66 of at least 98%. In an embodiment, the GH62 polypeptide has a sequence identity to SEQ ID NO: 66 of at least 99%.

In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of SEQ ID NO: 66. In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of SEQ ID NO: 69. In one embodiment, the polypeptide preferably comprises or consists of the amino acid sequence of SEQ ID NO: 66 or an allelic variant thereof; comprises SEQ ID NO: 66 or an allelic variant thereof and a N-terminal and/or C-terminal His-tag and/or HQ-tag such as SEQ ID NO: 69; or is a fragment thereof having arabinofuranosidase activity and having at least 90% of the length of SEQ ID NO: 66. In another embodiment, the polypeptide comprises or consists of amino acids 1 to 302 of SEQ ID NO: 66. In another embodiment, the polypeptide comprises or consists of amino acids 1 to 311 of SEQ ID NO: 69. In an embodiment, the polypeptide has been isolated.

In another embodiment, the composition comprises a GH62 polypeptide having arabinofuranosidase activity, wherein GH62 polypeptide having arabinofuranosidase activity has a sequence identity to the mature polypeptide of SEQ ID NO: 104 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%.

In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of the mature polypeptide of SEQ ID NO: 104. In one embodiment, the polypeptide preferably comprises or consists of the amino acid sequence of SEQ ID NO: 104 or an allelic variant thereof; comprises the amino acid sequence of SEQ ID NO: 104 and a N-terminal and/or C-terminal His-tag and/or HQ-tag; or is a fragment thereof having arabinofuranosidase activity and having at least 90% of the length of the mature polypeptide. In another embodiment, the polypeptide comprises or consists of the mature polypeptide of SEQ ID NO: 104. In another embodiment, the polypeptide comprises or consists of amino acids 1 to 302 of SEQ ID NO: 104. In an embodiment, the polypeptide has been isolated.

In an embodiment, the composition comprises a GH62 polypeptide having arabinofuranosidase activity having a sequence identity to SEQ ID NO: 105 of at least 80%. In an embodiment, the GH62 polypeptide has a sequence identity to SEQ ID NO: 105 of at least 85%. In an embodiment, the GH62 polypeptide has a sequence identity to SEQ ID NO: 105 of at least 86%. In an embodiment, the GH62 polypeptide has a sequence identity to SEQ ID NO: 105 of at least 87%. In an embodiment, the GH62 polypeptide has a sequence identity to SEQ ID NO: 105 of at least 88%. In an embodiment, the GH62 polypeptide has a sequence identity to SEQ ID NO: 105 of at least 89%. In an embodiment, the GH62 polypeptide has a sequence identity to SEQ ID NO: 105 of at least 90%. In an embodiment, the GH62 polypeptide has a sequence identity to SEQ ID NO: 105 of at least 91%. In an embodiment, the GH62 polypeptide has a sequence identity to SEQ ID NO: 105 of at least 92%. In an embodiment, the GH62 polypeptide has a sequence identity to SEQ ID NO: 105 of at least 93%. In an embodiment, the GH62 polypeptide has a sequence identity to SEQ ID NO: 105 of at least 94%. In an embodiment, the GH62 polypeptide has a sequence identity to SEQ ID NO: 105 of at least 95%. In an embodiment, the GH62 polypeptide has a sequence identity to SEQ ID NO: 105 of at least 96%. In an embodiment, the GH62 polypeptide has a sequence identity to SEQ ID NO: 105 of at least 97%. In an embodiment, the GH62 polypeptide has a sequence identity to SEQ ID NO: 105 of at least 98%. In an embodiment, the GH62 polypeptide has a sequence identity to SEQ ID NO: 105 of at least 99%.

In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of SEQ ID NO: 105. In one embodiment, the polypeptide preferably comprises or consists of the amino acid sequence of SEQ ID NO: 105 or an allelic variant thereof; comprises SEQ ID NO: 105 or an allelic variant thereof and a N-terminal and/or C-terminal His-tag and/or HQ-tag; or is a fragment thereof having arabinofuranosidase activity and having at least 90% of the length of SEQ ID NO: 105. In another embodiment, the polypeptide comprises or consists of amino acids 1 to 302 of SEQ ID NO: 105. In an embodiment, the polypeptide has been isolated.

In another embodiment, the composition comprises a GH62 polypeptide having arabinofuranosidase activity, wherein GH62 polypeptide having arabinofuranosidase activity has a sequence identity to the mature polypeptide of SEQ ID NO: 107 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%.

In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of the mature polypeptide of SEQ ID NO: 107. In one embodiment, the polypeptide preferably comprises or consists of the amino acid sequence of SEQ ID NO: 107 or an allelic variant thereof; comprises the amino acid sequence of SEQ ID NO: 107 and a N-terminal and/or C-terminal His-tag and/or HQ-tag such as the mature polypeptide of SEQ ID NO: 110 or SEQ ID NO: 111; or is a fragment thereof having arabinofuranosidase activity and having at least 90% of the length of the mature polypeptide. In another embodiment, the polypeptide comprises or consists of the mature polypeptide of SEQ ID NO: 107. In another embodiment, the polypeptide comprises or consists of amino acids 1 to 464 of SEQ ID NO: 107. In another embodiment, the polypeptide comprises or consists of the mature polypeptide of SEQ ID NO: 110. In another embodiment, the polypeptide comprises or consists of amino acids 1 to 472 of SEQ ID NO: 110. In an embodiment, the polypeptide has been isolated.

In an embodiment, the composition comprises a GH62 polypeptide having arabinofuranosidase activity having a sequence identity to SEQ ID NO: 108 of at least 80%. In an embodiment, the GH62 polypeptide has a sequence identity to SEQ ID NO: 108 of at least 85%. In an embodiment, the GH62 polypeptide has a sequence identity to SEQ ID NO: 108 of at least 86%. In an embodiment, the GH62 polypeptide has a sequence identity to SEQ ID NO: 108 of at least 87%. In an embodiment, the GH62 polypeptide has a sequence identity to SEQ ID NO: 108 of at least 88%. In an embodiment, the GH62 polypeptide has a sequence identity to SEQ ID NO: 108 of at least 89%. In an embodiment, the GH62 polypeptide has a sequence identity to SEQ ID NO: 108 of at least 90%. In an embodiment, the GH62 polypeptide has a sequence identity to SEQ ID NO: 108 of at least 91%. In an embodiment, the GH62 polypeptide has a sequence identity to SEQ ID NO: 108 of at least 92%. In an embodiment, the GH62 polypeptide has a sequence identity to SEQ ID NO: 108 of at least 93%. In an embodiment, the GH62 polypeptide has a sequence identity to SEQ ID NO: 108 of at least 94%. In an embodiment, the GH62 polypeptide has a sequence identity to SEQ ID NO: 108 of at least 95%. In an embodiment, the GH62 polypeptide has a sequence identity to SEQ ID NO: 108 of at least 96%. In an embodiment, the GH62 polypeptide has a sequence identity to SEQ ID NO: 108 of at least 97%. In an embodiment, the GH62 polypeptide has a sequence identity to SEQ ID NO: 108 of at least 98%. In an embodiment, the GH62 polypeptide has a sequence identity to SEQ ID NO: 108 of at least 99%.

In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of SEQ ID NO: 108. In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of SEQ ID NO: 111. In one embodiment, the polypeptide preferably comprises or consists of the amino acid sequence of SEQ ID NO: 108 or an allelic variant thereof; comprises SEQ ID NO: 108 or an allelic variant thereof and a N-terminal and/or C-terminal His-tag and/or HQ-tag such as SEQ ID NO: 111; or is a fragment thereof having arabinofuranosidase activity and having at least 90% of the length of SEQ ID NO: 108. In another embodiment, the polypeptide comprises or consists of amino acids 1 to 464 of SEQ ID NO: 108. In another embodiment, the polypeptide comprises or consists of amino acids 1 to 472 of SEQ ID NO: 111. In an embodiment, the polypeptide has been isolated.

In another embodiment, the composition comprises a GH62 polypeptide having arabinofuranosidase activity, wherein GH62 polypeptide having arabinofuranosidase activity has a sequence identity to the mature polypeptide of SEQ ID NO: 113 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%.

In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of the mature polypeptide of SEQ ID NO: 113. In one embodiment, the polypeptide preferably comprises or consists of the amino acid sequence of SEQ ID NO: 113 or an allelic variant thereof; comprises the amino acid sequence of SEQ ID NO: 113 and a N-terminal and/or C-terminal His-tag and/or HQ-tag such as the mature polypeptide of SEQ ID NO: 116 or SEQ ID NO: 117; or is a fragment thereof having arabinofuranosidase activity and having at least 90% of the length of the mature polypeptide. In another embodiment, the polypeptide comprises or consists of the mature polypeptide of SEQ ID NO: 113. In another embodiment, the polypeptide comprises or consists of amino acids 1 to 364 of SEQ ID NO: 113. In another embodiment, the polypeptide comprises or consists of the mature polypeptide of SEQ ID NO: 116. In another embodiment, the polypeptide comprises or consists of amino acids 1 to 372 of SEQ ID NO: 116. In an embodiment, the polypeptide has been isolated.

In an embodiment, the composition comprises a GH62 polypeptide having arabinofuranosidase activity having a sequence identity to SEQ ID NO: 114 of at least 80%. In an embodiment, the GH62 polypeptide has a sequence identity to SEQ ID NO: 114 of at least 85%. In an embodiment, the GH62 polypeptide has a sequence identity to SEQ ID NO: 114 of at least 86%. In an embodiment, the GH62 polypeptide has a sequence identity to SEQ ID NO: 114 of at least 87%. In an embodiment, the GH62 polypeptide has a sequence identity to SEQ ID NO: 114 of at least 88%. In an embodiment, the GH62 polypeptide has a sequence identity to SEQ ID NO: 114 of at least 89%. In an embodiment, the GH62 polypeptide has a sequence identity to SEQ ID NO: 114 of at least 90%. In an embodiment, the GH62 polypeptide has a sequence identity to SEQ ID NO: 114 of at least 91%. In an embodiment, the GH62 polypeptide has a sequence identity to SEQ ID NO: 114 of at least 92%. In an embodiment, the GH62 polypeptide has a sequence identity to SEQ ID NO: 114 of at least 93%. In an embodiment, the GH62 polypeptide has a sequence identity to SEQ ID NO: 114 of at least 94%. In an embodiment, the GH62 polypeptide has a sequence identity to SEQ ID NO: 114 of at least 95%. In an embodiment, the GH62 polypeptide has a sequence identity to SEQ ID NO: 114 of at least 96%. In an embodiment, the GH62 polypeptide has a sequence identity to SEQ ID NO: 114 of at least 97%. In an embodiment, the GH62 polypeptide has a sequence identity to SEQ ID NO: 114 of at least 98%. In an embodiment, the GH62 polypeptide has a sequence identity to SEQ ID NO: 114 of at least 99%.

In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of SEQ ID NO: 114. In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of SEQ ID NO: 117. In one embodiment, the polypeptide preferably comprises or consists of the amino acid sequence of SEQ ID NO: 114 or an allelic variant thereof; comprises SEQ ID NO: 114 or an allelic variant thereof and a N-terminal and/or C-terminal His-tag and/or HQ-tag such as SEQ ID NO: 117; or is a fragment thereof having arabinofuranosidase activity and having at least 90% of the length of SEQ ID NO: 114. In another embodiment, the polypeptide comprises or consists of amino acids 1 to 364 of SEQ ID NO: 114. In another embodiment, the polypeptide comprises or consists of amino acids 1 to 372 of SEQ ID NO: 117. In an embodiment, the polypeptide has been isolated.

In another embodiment, the composition comprises a GH62 polypeptide having arabinofuranosidase activity, wherein GH62 polypeptide having arabinofuranosidase activity has a sequence identity to the mature polypeptide of SEQ ID NO: 119 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%.

In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of the mature polypeptide of SEQ ID NO: 119. In one embodiment, the polypeptide preferably comprises or consists of the amino acid sequence of SEQ ID NO: 119 or an allelic variant thereof; comprises the amino acid sequence of SEQ ID NO: 119 and a N-terminal and/or C-terminal His-tag and/or HQ-tag; or is a fragment thereof having arabinofuranosidase activity and having at least 90% of the length of the mature polypeptide. In another embodiment, the polypeptide comprises or consists of the mature polypeptide of SEQ ID NO: 119. In another embodiment, the polypeptide comprises or consists of amino acids 1 to 357 of SEQ ID NO: 119. In an embodiment, the polypeptide has been isolated.

In an embodiment, the composition comprises a GH62 polypeptide having arabinofuranosidase activity having a sequence identity to SEQ ID NO: 120 of at least 80%. In an embodiment, the GH62 polypeptide has a sequence identity to SEQ ID NO: 120 of at least 85%. In an embodiment, the GH62 polypeptide has a sequence identity to SEQ ID NO: 120 of at least 86%. In an embodiment, the GH62 polypeptide has a sequence identity to SEQ ID NO: 120 of at least 87%. In an embodiment, the GH62 polypeptide has a sequence identity to SEQ ID NO: 120 of at least 88%. In an embodiment, the GH62 polypeptide has a sequence identity to SEQ ID NO: 120 of at least 89%. In an embodiment, the GH62 polypeptide has a sequence identity to SEQ ID NO: 120 of at least 90%. In an embodiment, the GH62 polypeptide has a sequence identity to SEQ ID NO: 120 of at least 91%. In an embodiment, the GH62 polypeptide has a sequence identity to SEQ ID NO: 120 of at least 92%. In an embodiment, the GH62 polypeptide has a sequence identity to SEQ ID NO: 120 of at least 93%. In an embodiment, the GH62 polypeptide has a sequence identity to SEQ ID NO: 120 of at least 94%. In an embodiment, the GH62 polypeptide has a sequence identity to SEQ ID NO: 120 of at least 95%. In an embodiment, the GH62 polypeptide has a sequence identity to SEQ ID NO: 120 of at least 96%. In an embodiment, the GH62 polypeptide has a sequence identity to SEQ ID NO: 120 of at least 97%. In an embodiment, the GH62 polypeptide has a sequence identity to SEQ ID NO: 120 of at least 98%. In an embodiment, the GH62 polypeptide has a sequence identity to SEQ ID NO: 120 of at least 99%.

In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of SEQ ID NO: 120. In one embodiment, the polypeptide preferably comprises or consists of the amino acid sequence of SEQ ID NO: 120 or an allelic variant thereof; comprises SEQ ID NO: 120 or an allelic variant thereof and a N-terminal and/or C-terminal His-tag and/or HQ-tag; or is a fragment thereof having arabinofuranosidase activity and having at least 90% of the length of SEQ ID NO: 120. In another embodiment, the polypeptide comprises or consists of amino acids 1 to 357 of SEQ ID NO: 120. In an embodiment, the polypeptide has been isolated.

In another embodiment, the composition comprises a GH62 polypeptide having arabinofuranosidase activity, wherein GH62 polypeptide having arabinofuranosidase activity has a sequence identity to the mature polypeptide of SEQ ID NO: 122 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%.

In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of the mature polypeptide of SEQ ID NO: 122. In one embodiment, the polypeptide preferably comprises or consists of the amino acid sequence of SEQ ID NO: 122 or an allelic variant thereof; comprises the amino acid sequence of SEQ ID NO: 122 and a N-terminal and/or C-terminal His-tag and/or HQ-tag; or is a fragment thereof having arabinofuranosidase activity and having at least 90% of the length of the mature polypeptide. In another embodiment, the polypeptide comprises or consists of the mature polypeptide of SEQ ID NO: 122. In another embodiment, the polypeptide comprises or consists of amino acids 1 to 302 of SEQ ID NO: 122. In an embodiment, the polypeptide has been isolated.

In an embodiment, the composition comprises a GH62 polypeptide having arabinofuranosidase activity having a sequence identity to SEQ ID NO: 123 of at least 80%. In an embodiment, the GH62 polypeptide has a sequence identity to SEQ ID NO: 123 of at least 85%. In an embodiment, the GH62 polypeptide has a sequence identity to SEQ ID NO: 123 of at least 86%. In an embodiment, the GH62 polypeptide has a sequence identity to SEQ ID NO: 123 of at least 87%. In an embodiment, the GH62 polypeptide has a sequence identity to SEQ ID NO: 123 of at least 88%. In an embodiment, the GH62 polypeptide has a sequence identity to SEQ ID NO: 123 of at least 89%. In an embodiment, the GH62 polypeptide has a sequence identity to SEQ ID NO: 123 of at least 90%. In an embodiment, the GH62 polypeptide has a sequence identity to SEQ ID NO: 123 of at least 91%. In an embodiment, the GH62 polypeptide has a sequence identity to SEQ ID NO: 123 of at least 92%. In an embodiment, the GH62 polypeptide has a sequence identity to SEQ ID NO: 123 of at least 93%. In an embodiment, the GH62 polypeptide has a sequence identity to SEQ ID NO: 123 of at least 94%. In an embodiment, the GH62 polypeptide has a sequence identity to SEQ ID NO: 123 of at least 95%. In an embodiment, the GH62 polypeptide has a sequence identity to SEQ ID NO: 123 of at least 96%. In an embodiment, the GH62 polypeptide has a sequence identity to SEQ ID NO: 123 of at least 97%. In an embodiment, the GH62 polypeptide has a sequence identity to SEQ ID NO: 123 of at least 98%. In an embodiment, the GH62 polypeptide has a sequence identity to SEQ ID NO: 123 of at least 99%.

In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of SEQ ID NO: 123. In one embodiment, the polypeptide preferably comprises or consists of the amino acid sequence of SEQ ID NO: 123 or an allelic variant thereof; comprises SEQ ID NO: 123 or an allelic variant thereof and a N-terminal and/or C-terminal His-tag and/or HQ-tag; or is a fragment thereof having arabinofuranosidase activity and having at least 90% of the length of SEQ ID NO: 123. In another embodiment, the polypeptide comprises or consists of amino acids 1 to 302 of SEQ ID NO: 123. In an embodiment, the polypeptide has been isolated.

In another embodiment, the composition comprises a GH62 polypeptide having arabinofuranosidase activity, wherein GH62 polypeptide having arabinofuranosidase activity has a sequence identity to the mature polypeptide of SEQ ID NO: 125 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%.

In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of the mature polypeptide of SEQ ID NO: 125. In one embodiment, the polypeptide preferably comprises or consists of the amino acid sequence of SEQ ID NO: 125 or an allelic variant thereof; comprises the amino acid sequence of SEQ ID NO: 125 and a N-terminal and/or C-terminal His-tag and/or HQ-tag such as the mature polypeptide of SEQ ID NO: 128 or SEQ ID NO: 129; or is a fragment thereof having arabinofuranosidase activity and having at least 90% of the length of the mature polypeptide. In another embodiment, the polypeptide comprises or consists of the mature polypeptide of SEQ ID NO: 125. In another embodiment, the polypeptide comprises or consists of amino acids 1 to 453 of SEQ ID NO: 125. In another embodiment, the polypeptide comprises or consists of the mature polypeptide of SEQ ID NO: 128. In another embodiment, the polypeptide comprises or consists of amino acids 1 to 461 of SEQ ID NO: 128. In an embodiment, the polypeptide has been isolated.

In an embodiment, the composition comprises a GH62 polypeptide having arabinofuranosidase activity having a sequence identity to SEQ ID NO: 126 of at least 80%. In an embodiment, the GH62 polypeptide has a sequence identity to SEQ ID NO: 126 of at least 85%. In an embodiment, the GH62 polypeptide has a sequence identity to SEQ ID NO: 126 of at least 86%. In an embodiment, the GH62 polypeptide has a sequence identity to SEQ ID NO: 126 of at least 87%. In an embodiment, the GH62 polypeptide has a sequence identity to SEQ ID NO: 126 of at least 88%. In an embodiment, the GH62 polypeptide has a sequence identity to SEQ ID NO: 126 of at least 89%. In an embodiment, the GH62 polypeptide has a sequence identity to SEQ ID NO: 126 of at least 90%. In an embodiment, the GH62 polypeptide has a sequence identity to SEQ ID NO: 126 of at least 91%. In an embodiment, the GH62 polypeptide has a sequence identity to SEQ ID NO: 126 of at least 92%. In an embodiment, the GH62 polypeptide has a sequence identity to SEQ ID NO: 126 of at least 93%. In an embodiment, the GH62 polypeptide has a sequence identity to SEQ ID NO: 126 of at least 94%. In an embodiment, the GH62 polypeptide has a sequence identity to SEQ ID NO: 126 of at least 95%. In an embodiment, the GH62 polypeptide has a sequence identity to SEQ ID NO: 126 of at least 96%. In an embodiment, the GH62 polypeptide has a sequence identity to SEQ ID NO: 126 of at least 97%. In an embodiment, the GH62 polypeptide has a sequence identity to SEQ ID NO: 126 of at least 98%. In an embodiment, the GH62 polypeptide has a sequence identity to SEQ ID NO: 126 of at least 99%.

In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of SEQ ID NO: 126. In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of SEQ ID NO: 129. In one embodiment, the polypeptide preferably comprises or consists of the amino acid sequence of SEQ ID NO: 126 or an allelic variant thereof; comprises SEQ ID NO: 126 or an allelic variant thereof and a N-terminal and/or C-terminal His-tag and/or HQ-tag such as SEQ ID NO: 129; or is a fragment thereof having arabinofuranosidase activity and having at least 90% of the length of SEQ ID NO: 126. In another embodiment, the polypeptide comprises or consists of amino acids 1 to 453 of SEQ ID NO: 126. In another embodiment, the polypeptide comprises or consists of amino acids 1 to 461 of SEQ ID NO: 129. In an embodiment, the polypeptide has been isolated.

In another embodiment, the composition comprises a GH62 polypeptide having arabinofuranosidase activity, wherein GH62 polypeptide having arabinofuranosidase activity has a sequence identity to the mature polypeptide of SEQ ID NO: 131 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%.

In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of the mature polypeptide of SEQ ID NO: 131. In one embodiment, the polypeptide preferably comprises or consists of the amino acid sequence of SEQ ID NO: 131 or an allelic variant thereof; comprises the amino acid sequence of SEQ ID NO: 131 and a N-terminal and/or C-terminal His-tag and/or HQ-tag such as the mature polypeptide of SEQ ID NO: 134 or SEQ ID NO: 135; or is a fragment thereof having arabinofuranosidase activity and having at least 90% of the length of the mature polypeptide. In another embodiment, the polypeptide comprises or consists of the mature polypeptide of SEQ ID NO: 131. In another embodiment, the polypeptide comprises or consists of amino acids 1 to 377 of SEQ ID NO: 131. In another embodiment, the polypeptide comprises or consists of the mature polypeptide of SEQ ID NO: 134. In another embodiment, the polypeptide comprises or consists of amino acids 1 to 385 of SEQ ID NO: 134. In an embodiment, the polypeptide has been isolated.

In an embodiment, the composition comprises a GH62 polypeptide having arabinofuranosidase activity having a sequence identity to SEQ ID NO: 132 of at least 80%. In an embodiment, the GH62 polypeptide has a sequence identity to SEQ ID NO: 132 of at least 85%. In an embodiment, the GH62 polypeptide has a sequence identity to SEQ ID NO: 132 of at least 86%. In an embodiment, the GH62 polypeptide has a sequence identity to SEQ ID NO: 132 of at least 87%. In an embodiment, the GH62 polypeptide has a sequence identity to SEQ ID NO: 132 of at least 88%. In an embodiment, the GH62 polypeptide has a sequence identity to SEQ ID NO: 132 of at least 89%. In an embodiment, the GH62 polypeptide has a sequence identity to SEQ ID NO: 132 of at least 90%. In an embodiment, the GH62 polypeptide has a sequence identity to SEQ ID NO: 132 of at least 91%. In an embodiment, the GH62 polypeptide has a sequence identity to SEQ ID NO: 132 of at least 92%. In an embodiment, the GH62 polypeptide has a sequence identity to SEQ ID NO: 132 of at least 93%. In an embodiment, the GH62 polypeptide has a sequence identity to SEQ ID NO: 132 of at least 94%. In an embodiment, the GH62 polypeptide has a sequence identity to SEQ ID NO: 132 of at least 95%. In an embodiment, the GH62 polypeptide has a sequence identity to SEQ ID NO: 132 of at least 96%. In an embodiment, the GH62 polypeptide has a sequence identity to SEQ ID NO: 132 of at least 97%. In an embodiment, the GH62 polypeptide has a sequence identity to SEQ ID NO: 132 of at least 98%. In an embodiment, the GH62 polypeptide has a sequence identity to SEQ ID NO: 132 of at least 99%.

In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of SEQ ID NO: 132. In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of SEQ ID NO: 135. In one embodiment, the polypeptide preferably comprises or consists of the amino acid sequence of SEQ ID NO: 132 or an allelic variant thereof; comprises SEQ ID NO: 132 or an allelic variant thereof and a N-terminal and/or C-terminal His-tag and/or HQ-tag such as SEQ ID NO: 135; or is a fragment thereof having arabinofuranosidase activity and having at least 90% of the length of SEQ ID NO: 132. In another embodiment, the polypeptide comprises or consists of amino acids 1 to 377 of SEQ ID NO: 132. In another embodiment, the polypeptide comprises or consists of amino acids 1 to 385 of SEQ ID NO: 135. In an embodiment, the polypeptide has been isolated.

In another embodiment, the composition comprises a GH62 polypeptide having arabinofuranosidase activity, wherein GH62 polypeptide having arabinofuranosidase activity has a sequence identity to the mature polypeptide of SEQ ID NO: 137 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%.

In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of the mature polypeptide of SEQ ID NO: 137. In one embodiment, the polypeptide preferably comprises or consists of the amino acid sequence of SEQ ID NO: 137 or an allelic variant thereof; comprises the amino acid sequence of SEQ ID NO: 137 and a N-terminal and/or C-terminal His-tag and/or HQ-tag; or is a fragment thereof having arabinofuranosidase activity and having at least 90% of the length of the mature polypeptide. In another embodiment, the polypeptide comprises or consists of the mature polypeptide of SEQ ID NO: 137. In another embodiment, the polypeptide comprises or consists of amino acids 1 to 309 of SEQ ID NO: 137. In an embodiment, the polypeptide has been isolated.

In an embodiment, the composition comprises a GH62 polypeptide having arabinofuranosidase activity having a sequence identity to SEQ ID NO: 138 of at least 80%. In an embodiment, the GH62 polypeptide has a sequence identity to SEQ ID NO: 138 of at least 85%. In an embodiment, the GH62 polypeptide has a sequence identity to SEQ ID NO: 138 of at least 86%. In an embodiment, the GH62 polypeptide has a sequence identity to SEQ ID NO: 138 of at least 87%. In an embodiment, the GH62 polypeptide has a sequence identity to SEQ ID NO: 138 of at least 88%. In an embodiment, the GH62 polypeptide has a sequence identity to SEQ ID NO: 138 of at least 89%. In an embodiment, the GH62 polypeptide has a sequence identity to SEQ ID NO: 138 of at least 90%. In an embodiment, the GH62 polypeptide has a sequence identity to SEQ ID NO: 138 of at least 91%. In an embodiment, the GH62 polypeptide has a sequence identity to SEQ ID NO: 138 of at least 92%. In an embodiment, the GH62 polypeptide has a sequence identity to SEQ ID NO: 138 of at least 93%. In an embodiment, the GH62 polypeptide has a sequence identity to SEQ ID NO: 138 of at least 94%. In an embodiment, the GH62 polypeptide has a sequence identity to SEQ ID NO: 138 of at least 95%. In an embodiment, the GH62 polypeptide has a sequence identity to SEQ ID NO: 138 of at least 96%. In an embodiment, the GH62 polypeptide has a sequence identity to SEQ ID NO: 138 of at least 97%. In an embodiment, the GH62 polypeptide has a sequence identity to SEQ ID NO: 138 of at least 98%. In an embodiment, the GH62 polypeptide has a sequence identity to SEQ ID NO: 138 of at least 99%.

In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of SEQ ID NO: 138. In one embodiment, the polypeptide preferably comprises or consists of the amino acid sequence of SEQ ID NO: 138 or an allelic variant thereof; comprises SEQ ID NO: 138 or an allelic variant thereof and a N-terminal and/or C-terminal His-tag and/or HQ-tag; or is a fragment thereof having arabinofuranosidase activity and having at least 90% of the length of SEQ ID NO: 138. In another embodiment, the polypeptide comprises or consists of amino acids 1 to 308 of SEQ ID NO: 138. In an embodiment, the polypeptide has been isolated.

In another embodiment, the composition comprises a GH62 polypeptide having arabinofuranosidase activity, wherein GH62 polypeptide having arabinofuranosidase activity has a sequence identity to the mature polypeptide of SEQ ID NO: 140 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%.

In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of the mature polypeptide of SEQ ID NO: 140. In one embodiment, the polypeptide preferably comprises or consists of the amino acid sequence of SEQ ID NO: 140 or an allelic variant thereof; comprises the amino acid sequence of SEQ ID NO: 140 and a N-terminal and/or C-terminal His-tag and/or HQ-tag such as the mature polypeptide of SEQ ID NO: 143 or SEQ ID NO: 144; or is a fragment thereof having arabinofuranosidase activity and having at least 90% of the length of the mature polypeptide. In another embodiment, the polypeptide comprises or consists of the mature polypeptide of SEQ ID NO: 140. In another embodiment, the polypeptide comprises or consists of amino acids 1 to 304 of SEQ ID NO: 140. In another embodiment, the polypeptide comprises or consists of the mature polypeptide of SEQ ID NO: 143. In another embodiment, the polypeptide comprises or consists of amino acids 1 to 312 of SEQ ID NO: 143. In an embodiment, the polypeptide has been isolated.

In an embodiment, the composition comprises a GH62 polypeptide having arabinofuranosidase activity having a sequence identity to SEQ ID NO: 141 of at least 80%. In an embodiment, the GH62 polypeptide has a sequence identity to SEQ ID NO: 141 of at least 85%. In an embodiment, the GH62 polypeptide has a sequence identity to SEQ ID NO: 141 of at least 86%. In an embodiment, the GH62 polypeptide has a sequence identity to SEQ ID NO: 141 of at least 87%. In an embodiment, the GH62 polypeptide has a sequence identity to SEQ ID NO: 141 of at least 88%. In an embodiment, the GH62 polypeptide has a sequence identity to SEQ ID NO: 141 of at least 89%. In an embodiment, the GH62 polypeptide has a sequence identity to SEQ ID NO: 141 of at least 90%. In an embodiment, the GH62 polypeptide has a sequence identity to SEQ ID NO: 141 of at least 91%. In an embodiment, the GH62 polypeptide has a sequence identity to SEQ ID NO: 141 of at least 92%. In an embodiment, the GH62 polypeptide has a sequence identity to SEQ ID NO: 141 of at least 93%. In an embodiment, the GH62 polypeptide has a sequence identity to SEQ ID NO: 141 of at least 94%. In an embodiment, the GH62 polypeptide has a sequence identity to SEQ ID NO: 141 of at least 95%. In an embodiment, the GH62 polypeptide has a sequence identity to SEQ ID NO: 141 of at least 96%. In an embodiment, the GH62 polypeptide has a sequence identity to SEQ ID NO: 141 of at least 97%. In an embodiment, the GH62 polypeptide has a sequence identity to SEQ ID NO: 141 of at least 98%. In an embodiment, the GH62 polypeptide has a sequence identity to SEQ ID NO: 141 of at least 99%.

In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of SEQ ID NO: 141. In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of SEQ ID NO: 144. In one embodiment, the polypeptide preferably comprises or consists of the amino acid sequence of SEQ ID NO: 141 or an allelic variant thereof; comprises SEQ ID NO: 141 or an allelic variant thereof and a N-terminal and/or C-terminal His-tag and/or HQ-tag such as SEQ ID NO: 144; or is a fragment thereof having arabinofuranosidase activity and having at least 90% of the length of SEQ ID NO: 141. In another embodiment, the polypeptide comprises or consists of amino acids 1 to 304 of SEQ ID NO: 141. In another embodiment, the polypeptide comprises or consists of amino acids 1 to 312 of SEQ ID NO: 144. In an embodiment, the polypeptide has been isolated.

In another embodiment, the composition comprises a GH62 polypeptide having arabinofuranosidase activity, wherein GH62 polypeptide having arabinofuranosidase activity has a sequence identity to the mature polypeptide of SEQ ID NO: 146 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%.

In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of the mature polypeptide of SEQ ID NO: 146. In one embodiment, the polypeptide preferably comprises or consists of the amino acid sequence of SEQ ID NO: 146 or an allelic variant thereof; comprises the amino acid sequence of SEQ ID NO: 146 and a N-terminal and/or C-terminal His-tag and/or HQ-tag; or is a fragment thereof having arabinofuranosidase activity and having at least 90% of the length of the mature polypeptide. In another embodiment, the polypeptide comprises or consists of the mature polypeptide of SEQ ID NO: 146. In another embodiment, the polypeptide comprises or consists of amino acids 1 to 302 of SEQ ID NO: 146. In an embodiment, the polypeptide has been isolated.

In an embodiment, the composition comprises a GH62 polypeptide having arabinofuranosidase activity having a sequence identity to SEQ ID NO: 147 of at least 80%. In an embodiment, the GH62 polypeptide has a sequence identity to SEQ ID NO: 147 of at least 85%. In an embodiment, the GH62 polypeptide has a sequence identity to SEQ ID NO: 147 of at least 86%. In an embodiment, the GH62 polypeptide has a sequence identity to SEQ ID NO: 147 of at least 87%. In an embodiment, the GH62 polypeptide has a sequence identity to SEQ ID NO: 147 of at least 88%. In an embodiment, the GH62 polypeptide has a sequence identity to SEQ ID NO: 147 of at least 89%. In an embodiment, the GH62 polypeptide has a sequence identity to SEQ ID NO: 147 of at least 90%. In an embodiment, the GH62 polypeptide has a sequence identity to SEQ ID NO: 147 of at least 91%. In an embodiment, the GH62 polypeptide has a sequence identity to SEQ ID NO: 147 of at least 92%. In an embodiment, the GH62 polypeptide has a sequence identity to SEQ ID NO: 147 of at least 93%. In an embodiment, the GH62 polypeptide has a sequence identity to SEQ ID NO: 147 of at least 94%. In an embodiment, the GH62 polypeptide has a sequence identity to SEQ ID NO: 147 of at least 95%. In an embodiment, the GH62 polypeptide has a sequence identity to SEQ ID NO: 147 of at least 96%. In an embodiment, the GH62 polypeptide has a sequence identity to SEQ ID NO: 147 of at least 97%. In an embodiment, the GH62 polypeptide has a sequence identity to SEQ ID NO: 147 of at least 98%. In an embodiment, the GH62 polypeptide has a sequence identity to SEQ ID NO: 147 of at least 99%.

In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of SEQ ID NO: 147. In one embodiment, the polypeptide preferably comprises or consists of the amino acid sequence of SEQ ID NO: 147 or an allelic variant thereof; comprises SEQ ID NO: 147 or an allelic variant thereof and a N-terminal and/or C-terminal His-tag and/or HQ-tag; or is a fragment thereof having arabinofuranosidase activity and having at least 90% of the length of SEQ ID NO: 147. In another embodiment, the polypeptide comprises or consists of amino acids 1 to 302 of SEQ ID NO: 147. In an embodiment, the polypeptide has been isolated.

In another embodiment, the composition comprises a GH62 polypeptide having arabinofuranosidase activity, wherein GH62 polypeptide having arabinofuranosidase activity has a sequence identity to the mature polypeptide of SEQ ID NO: 149 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%.

In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of the mature polypeptide of SEQ ID NO: 149. In one embodiment, the polypeptide preferably comprises or consists of the amino acid sequence of SEQ ID NO: 149 or an allelic variant thereof; comprises the amino acid sequence of SEQ ID NO: 149 and a N-terminal and/or C-terminal His-tag and/or HQ-tag such as the mature polypeptide of SEQ ID NO: 152 or SEQ ID NO: 153; or is a fragment thereof having arabinofuranosidase activity and having at least 90% of the length of the mature polypeptide. In another embodiment, the polypeptide comprises or consists of the mature polypeptide of SEQ ID NO: 149. In another embodiment, the polypeptide comprises or consists of amino acids 1 to 302 of SEQ ID NO: 149. In another embodiment, the polypeptide comprises or consists of the mature polypeptide of SEQ ID NO: 152. In another embodiment, the polypeptide comprises or consists of amino acids 1 to 310 of SEQ ID NO: 152. In an embodiment, the polypeptide has been isolated.

In an embodiment, the composition comprises a GH62 polypeptide having arabinofuranosidase activity having a sequence identity to SEQ ID NO: 150 of at least 80%. In an embodiment, the GH62 polypeptide has a sequence identity to SEQ ID NO: 150 of at least 85%. In an embodiment, the GH62 polypeptide has a sequence identity to SEQ ID NO: 150 of at least 86%. In an embodiment, the GH62 polypeptide has a sequence identity to SEQ ID NO: 150 of at least 87%. In an embodiment, the GH62 polypeptide has a sequence identity to SEQ ID NO: 150 of at least 88%. In an embodiment, the GH62 polypeptide has a sequence identity to SEQ ID NO: 150 of at least 89%. In an embodiment, the GH62 polypeptide has a sequence identity to SEQ ID NO: 150 of at least 90%. In an embodiment, the GH62 polypeptide has a sequence identity to SEQ ID NO: 150 of at least 91%. In an embodiment, the GH62 polypeptide has a sequence identity to SEQ ID NO: 150 of at least 92%. In an embodiment, the GH62 polypeptide has a sequence identity to SEQ ID NO: 150 of at least 93%. In an embodiment, the GH62 polypeptide has a sequence identity to SEQ ID NO: 150 of at least 94%. In an embodiment, the GH62 polypeptide has a sequence identity to SEQ ID NO: 150 of at least 95%. In an embodiment, the GH62 polypeptide has a sequence identity to SEQ ID NO: 150 of at least 96%. In an embodiment, the GH62 polypeptide has a sequence identity to SEQ ID NO: 150 of at least 97%. In an embodiment, the GH62 polypeptide has a sequence identity to SEQ ID NO: 150 of at least 98%. In an embodiment, the GH62 polypeptide has a sequence identity to SEQ ID NO: 150 of at least 99%.

In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of SEQ ID NO: 150. In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of SEQ ID NO: 153. In one embodiment, the polypeptide preferably comprises or consists of the amino acid sequence of SEQ ID NO: 150 or an allelic variant thereof; comprises SEQ ID NO: 150 or an allelic variant thereof and a N-terminal and/or C-terminal His-tag and/or HQ-tag such as SEQ ID NO: 153; or is a fragment thereof having arabinofuranosidase activity and having at least 90% of the length of SEQ ID NO: 150. In another embodiment, the polypeptide comprises or consists of amino acids 1 to 302 of SEQ ID NO: 150. In another embodiment, the polypeptide comprises or consists of amino acids 1 to 310 of SEQ ID NO: 153. In an embodiment, the polypeptide has been isolated.

In another embodiment, the composition comprises a GH62 polypeptide having arabinofuranosidase activity, wherein GH62 polypeptide having arabinofuranosidase activity has a sequence identity to the mature polypeptide of SEQ ID NO: 155 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%.

In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of the mature polypeptide of SEQ ID NO: 155. In one embodiment, the polypeptide preferably comprises or consists of the amino acid sequence of SEQ ID NO: 155 or an allelic variant thereof; comprises the amino acid sequence of SEQ ID NO: 155 and a N-terminal and/or C-terminal His-tag and/or HQ-tag; or is a fragment thereof having arabinofuranosidase activity and having at least 90% of the length of the mature polypeptide. In another embodiment, the polypeptide comprises or consists of the mature polypeptide of SEQ ID NO: 155. In another embodiment, the polypeptide comprises or consists of amino acids 1 to 316 of SEQ ID NO: 155. In an embodiment, the polypeptide has been isolated.

In an embodiment, the composition comprises a GH62 polypeptide having arabinofuranosidase activity having a sequence identity to SEQ ID NO: 156 of at least 80%. In an embodiment, the GH62 polypeptide has a sequence identity to SEQ ID NO: 156 of at least 85%. In an embodiment, the GH62 polypeptide has a sequence identity to SEQ ID NO: 156 of at least 86%. In an embodiment, the GH62 polypeptide has a sequence identity to SEQ ID NO: 156 of at least 87%. In an embodiment, the GH62 polypeptide has a sequence identity to SEQ ID NO: 156 of at least 88%. In an embodiment, the GH62 polypeptide has a sequence identity to SEQ ID NO: 156 of at least 89%. In an embodiment, the GH62 polypeptide has a sequence identity to SEQ ID NO: 156 of at least 90%. In an embodiment, the GH62 polypeptide has a sequence identity to SEQ ID NO: 156 of at least 91%. In an embodiment, the GH62 polypeptide has a sequence identity to SEQ ID NO: 156 of at least 92%. In an embodiment, the GH62 polypeptide has a sequence identity to SEQ ID NO: 156 of at least 93%. In an embodiment, the GH62 polypeptide has a sequence identity to SEQ ID NO: 156 of at least 94%. In an embodiment, the GH62 polypeptide has a sequence identity to SEQ ID NO: 156 of at least 95%. In an embodiment, the GH62 polypeptide has a sequence identity to SEQ ID NO: 156 of at least 96%. In an embodiment, the GH62 polypeptide has a sequence identity to SEQ ID NO: 156 of at least 97%. In an embodiment, the GH62 polypeptide has a sequence identity to SEQ ID NO: 156 of at least 98%. In an embodiment, the GH62 polypeptide has a sequence identity to SEQ ID NO: 156 of at least 99%.

In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of SEQ ID NO: 156. In one embodiment, the polypeptide preferably comprises or consists of the amino acid sequence of SEQ ID NO: 156 or an allelic variant thereof; comprises SEQ ID NO: 156 or an allelic variant thereof and a N-terminal and/or C-terminal His-tag and/or HQ-tag; or is a fragment thereof having arabinofuranosidase activity and having at least 90% of the length of SEQ ID NO: 156. In another embodiment, the polypeptide comprises or consists of amino acids 1 to 316 of SEQ ID NO: 156. In an embodiment, the polypeptide has been isolated.

In another embodiment, the composition comprises a GH62 polypeptide having arabinofuranosidase activity, wherein GH62 polypeptide having arabinofuranosidase activity has a sequence identity to the mature polypeptide of SEQ ID NO: 158 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%.

In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of the mature polypeptide of SEQ ID NO: 158. In one embodiment, the polypeptide preferably comprises or consists of the amino acid sequence of SEQ ID NO: 158 or an allelic variant thereof; comprises the amino acid sequence of SEQ ID NO: 158 and a N-terminal and/or C-terminal His-tag and/or HQ-tag; or is a fragment thereof having arabinofuranosidase activity and having at least 90% of the length of the mature polypeptide. In another embodiment, the polypeptide comprises or consists of the mature polypeptide of SEQ ID NO: 158. In another embodiment, the polypeptide comprises or consists of amino acids 1 to 316 of SEQ ID NO: 158. In an embodiment, the polypeptide has been isolated.

In an embodiment, the composition comprises a GH62 polypeptide having arabinofuranosidase activity having a sequence identity to SEQ ID NO: 159 of at least 80%. In an embodiment, the GH62 polypeptide has a sequence identity to SEQ ID NO: 159 of at least 85%. In an embodiment, the GH62 polypeptide has a sequence identity to SEQ ID NO: 159 of at least 86%. In an embodiment, the GH62 polypeptide has a sequence identity to SEQ ID NO: 159 of at least 87%. In an embodiment, the GH62 polypeptide has a sequence identity to SEQ ID NO: 159 of at least 88%. In an embodiment, the GH62 polypeptide has a sequence identity to SEQ ID NO: 159 of at least 89%. In an embodiment, the GH62 polypeptide has a sequence identity to SEQ ID NO: 159 of at least 90%. In an embodiment, the GH62 polypeptide has a sequence identity to SEQ ID NO: 159 of at least 91%. In an embodiment, the GH62 polypeptide has a sequence identity to SEQ ID NO: 159 of at least 92%. In an embodiment, the GH62 polypeptide has a sequence identity to SEQ ID NO: 159 of at least 93%. In an embodiment, the GH62 polypeptide has a sequence identity to SEQ ID NO: 159 of at least 94%. In an embodiment, the GH62 polypeptide has a sequence identity to SEQ ID NO: 159 of at least 95%. In an embodiment, the GH62 polypeptide has a sequence identity to SEQ ID NO: 159 of at least 96%. In an embodiment, the GH62 polypeptide has a sequence identity to SEQ ID NO: 159 of at least 97%. In an embodiment, the GH62 polypeptide has a sequence identity to SEQ ID NO: 159 of at least 98%. In an embodiment, the GH62 polypeptide has a sequence identity to SEQ ID NO: 159 of at least 99%.

In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of SEQ ID NO: 159. In one embodiment, the polypeptide preferably comprises or consists of the amino acid sequence of SEQ ID NO: 159 or an allelic variant thereof; comprises SEQ ID NO: 159 or an allelic variant thereof and a N-terminal and/or C-terminal His-tag and/or HQ-tag; or is a fragment thereof having arabinofuranosidase activity and having at least 90% of the length of SEQ ID NO: 159. In another embodiment, the polypeptide comprises or consists of amino acids 1 to 316 of SEQ ID NO: 159. In an embodiment, the polypeptide has been isolated.

In another embodiment, the composition comprises a GH62 polypeptide having arabinofuranosidase activity, wherein GH62 polypeptide having arabinofuranosidase activity has a sequence identity to the mature polypeptide of SEQ ID NO: 161 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%.

In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of the mature polypeptide of SEQ ID NO: 161. In one embodiment, the polypeptide preferably comprises or consists of the amino acid sequence of SEQ ID NO: 161 or an allelic variant thereof; comprises the amino acid sequence of SEQ ID NO: 161 and a N-terminal and/or C-terminal His-tag and/or HQ-tag; or is a fragment thereof having arabinofuranosidase activity and having at least 90% of the length of the mature polypeptide. In another embodiment, the polypeptide comprises or consists of the mature polypeptide of SEQ ID NO: 161. In another embodiment, the polypeptide comprises or consists of amino acids 1 to 303 of SEQ ID NO: 161. In an embodiment, the polypeptide has been isolated.

In an embodiment, the composition comprises a GH62 polypeptide having arabinofuranosidase activity having a sequence identity to SEQ ID NO: 162 of at least 80%. In an embodiment, the GH62 polypeptide has a sequence identity to SEQ ID NO: 162 of at least 85%. In an embodiment, the GH62 polypeptide has a sequence identity to SEQ ID NO: 162 of at least 86%. In an embodiment, the GH62 polypeptide has a sequence identity to SEQ ID NO: 162 of at least 87%. In an embodiment, the GH62 polypeptide has a sequence identity to SEQ ID NO: 162 of at least 88%. In an embodiment, the GH62 polypeptide has a sequence identity to SEQ ID NO: 162 of at least 89%. In an embodiment, the GH62 polypeptide has a sequence identity to SEQ ID NO: 162 of at least 90%. In an embodiment, the GH62 polypeptide has a sequence identity to SEQ ID NO: 162 of at least 91%. In an embodiment, the GH62 polypeptide has a sequence identity to SEQ ID NO: 162 of at least 92%. In an embodiment, the GH62 polypeptide has a sequence identity to SEQ ID NO: 162 of at least 93%. In an embodiment, the GH62 polypeptide has a sequence identity to SEQ ID NO: 162 of at least 94%. In an embodiment, the GH62 polypeptide has a sequence identity to SEQ ID NO: 162 of at least 95%. In an embodiment, the GH62 polypeptide has a sequence identity to SEQ ID NO: 162 of at least 96%. In an embodiment, the GH62 polypeptide has a sequence identity to SEQ ID NO: 162 of at least 97%. In an embodiment, the GH62 polypeptide has a sequence identity to SEQ ID NO: 162 of at least 98%. In an embodiment, the GH62 polypeptide has a sequence identity to SEQ ID NO: 162 of at least 99%.

In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of SEQ ID NO: 162. In one embodiment, the polypeptide preferably comprises or consists of the amino acid sequence of SEQ ID NO: 162 or an allelic variant thereof; comprises SEQ ID NO: 162 or an allelic variant thereof and a N-terminal and/or C-terminal His-tag and/or HQ-tag; or is a fragment thereof having arabinofuranosidase activity and having at least 90% of the length of SEQ ID NO: 162. In another embodiment, the polypeptide comprises or consists of amino acids 1 to 303 of SEQ ID NO: 162. In an embodiment, the polypeptide has been isolated.

In another embodiment, the composition comprises a GH62 polypeptide having arabinofuranosidase activity, wherein GH62 polypeptide having arabinofuranosidase activity has a sequence identity to the mature polypeptide of SEQ ID NO: 164 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%.

In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of the mature polypeptide of SEQ ID NO: 164. In one embodiment, the polypeptide preferably comprises or consists of the amino acid sequence of SEQ ID NO: 164 or an allelic variant thereof; comprises the amino acid sequence of SEQ ID NO: 164 and a N-terminal and/or C-terminal His-tag and/or HQ-tag; or is a fragment thereof having arabinofuranosidase activity and having at least 90% of the length of the mature polypeptide. In another embodiment, the polypeptide comprises or consists of the mature polypeptide of SEQ ID NO: 164. In another embodiment, the polypeptide comprises or consists of amino acids 1 to 361 of SEQ ID NO: 164. In an embodiment, the polypeptide has been isolated.

In an embodiment, the composition comprises a GH62 polypeptide having arabinofuranosidase activity having a sequence identity to SEQ ID NO: 165 of at least 80%. In an embodiment, the GH62 polypeptide has a sequence identity to SEQ ID NO: 165 of at least 85%. In an embodiment, the GH62 polypeptide has a sequence identity to SEQ ID NO: 165 of at least 86%. In an embodiment, the GH62 polypeptide has a sequence identity to SEQ ID NO: 165 of at least 87%. In an embodiment, the GH62 polypeptide has a sequence identity to SEQ ID NO: 165 of at least 88%. In an embodiment, the GH62 polypeptide has a sequence identity to SEQ ID NO: 165 of at least 89%. In an embodiment, the GH62 polypeptide has a sequence identity to SEQ ID NO: 165 of at least 90%. In an embodiment, the GH62 polypeptide has a sequence identity to SEQ ID NO: 165 of at least 91%. In an embodiment, the GH62 polypeptide has a sequence identity to SEQ ID NO: 165 of at least 92%. In an embodiment, the GH62 polypeptide has a sequence identity to SEQ ID NO: 165 of at least 93%. In an embodiment, the GH62 polypeptide has a sequence identity to SEQ ID NO: 165 of at least 94%. In an embodiment, the GH62 polypeptide has a sequence identity to SEQ ID NO: 165 of at least 95%. In an embodiment, the GH62 polypeptide has a sequence identity to SEQ ID NO: 165 of at least 96%. In an embodiment, the GH62 polypeptide has a sequence identity to SEQ ID NO: 165 of at least 97%. In an embodiment, the GH62 polypeptide has a sequence identity to SEQ ID NO: 165 of at least 98%. In an embodiment, the GH62 polypeptide has a sequence identity to SEQ ID NO: 165 of at least 99%.

In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of SEQ ID NO: 165. In one embodiment, the polypeptide preferably comprises or consists of the amino acid sequence of SEQ ID NO: 165 or an allelic variant thereof; comprises SEQ ID NO: 165 or an allelic variant thereof and a N-terminal and/or C-terminal His-tag and/or HQ-tag; or is a fragment thereof having arabinofuranosidase activity and having at least 90% of the length of SEQ ID NO: 165. In another embodiment, the polypeptide comprises or consists of amino acids 1 to 361 of SEQ ID NO: 165. In an embodiment, the polypeptide has been isolated.

In another embodiment, the composition comprises a GH62 polypeptide having arabinofuranosidase activity, wherein GH62 polypeptide having arabinofuranosidase activity has a sequence identity to the mature polypeptide of SEQ ID NO: 167 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%.

In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of the mature polypeptide of SEQ ID NO: 167. In one embodiment, the polypeptide preferably comprises or consists of the amino acid sequence of SEQ ID NO: 167 or an allelic variant thereof; comprises the amino acid sequence of SEQ ID NO: 167 and a N-terminal and/or C-terminal His-tag and/or HQ-tag; or is a fragment thereof having arabinofuranosidase activity and having at least 90% of the length of the mature polypeptide. In another embodiment, the polypeptide comprises or consists of the mature polypeptide of SEQ ID NO: 167. In another embodiment, the polypeptide comprises or consists of amino acids 1 to 373 of SEQ ID NO: 167. In an embodiment, the polypeptide has been isolated.

In an embodiment, the composition comprises a GH62 polypeptide having arabinofuranosidase activity having a sequence identity to SEQ ID NO: 168 of at least 80%. In an embodiment, the GH62 polypeptide has a sequence identity to SEQ ID NO: 168 of at least 85%. In an embodiment, the GH62 polypeptide has a sequence identity to SEQ ID NO: 168 of at least 86%. In an embodiment, the GH62 polypeptide has a sequence identity to SEQ ID NO: 168 of at least 87%. In an embodiment, the GH62 polypeptide has a sequence identity to SEQ ID NO: 168 of at least 88%. In an embodiment, the GH62 polypeptide has a sequence identity to SEQ ID NO: 168 of at least 89%. In an embodiment, the GH62 polypeptide has a sequence identity to SEQ ID NO: 168 of at least 90%. In an embodiment, the GH62 polypeptide has a sequence identity to SEQ ID NO: 168 of at least 91%. In an embodiment, the GH62 polypeptide has a sequence identity to SEQ ID NO: 168 of at least 92%. In an embodiment, the GH62 polypeptide has a sequence identity to SEQ ID NO: 168 of at least 93%. In an embodiment, the GH62 polypeptide has a sequence identity to SEQ ID NO: 168 of at least 94%. In an embodiment, the GH62 polypeptide has a sequence identity to SEQ ID NO: 168 of at least 95%. In an embodiment, the GH62 polypeptide has a sequence identity to SEQ ID NO: 168 of at least 96%. In an embodiment, the GH62 polypeptide has a sequence identity to SEQ ID NO: 168 of at least 97%. In an embodiment, the GH62 polypeptide has a sequence identity to SEQ ID NO: 168 of at least 98%. In an embodiment, the GH62 polypeptide has a sequence identity to SEQ ID NO: 168 of at least 99%.

In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of SEQ ID NO: 168. In one embodiment, the polypeptide preferably comprises or consists of the amino acid sequence of SEQ ID NO: 168 or an allelic variant thereof; comprises SEQ ID NO: 168 or an allelic variant thereof and a N-terminal and/or C-terminal His-tag and/or HQ-tag; or is a fragment thereof having arabinofuranosidase activity and having at least 90% of the length of SEQ ID NO: 168. In another embodiment, the polypeptide comprises or consists of amino acids 1 to 373 of SEQ ID NO: 168. In an embodiment, the polypeptide has been isolated.

In another embodiment, the composition comprises a GH62 polypeptide having arabinofuranosidase activity, wherein GH62 polypeptide having arabinofuranosidase activity has a sequence identity to the mature polypeptide of SEQ ID NO: 170 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%.

In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of the mature polypeptide of SEQ ID NO: 170. In one embodiment, the polypeptide preferably comprises or consists of the amino acid sequence of SEQ ID NO: 170 or an allelic variant thereof; comprises the amino acid sequence of SEQ ID NO: 170 and a N-terminal and/or C-terminal His-tag and/or HQ-tag; or is a fragment thereof having arabinofuranosidase activity and having at least 90% of the length of the mature polypeptide. In another embodiment, the polypeptide comprises or consists of the mature polypeptide of SEQ ID NO: 170. In another embodiment, the polypeptide comprises or consists of amino acids 1 to 302 of SEQ ID NO: 170. In an embodiment, the polypeptide has been isolated.

In an embodiment, the composition comprises a GH62 polypeptide having arabinofuranosidase activity having a sequence identity to SEQ ID NO: 171 of at least 80%. In an embodiment, the GH62 polypeptide has a sequence identity to SEQ ID NO: 171 of at least 85%. In an embodiment, the GH62 polypeptide has a sequence identity to SEQ ID NO: 171 of at least 86%. In an embodiment, the GH62 polypeptide has a sequence identity to SEQ ID NO: 171 of at least 87%. In an embodiment, the GH62 polypeptide has a sequence identity to SEQ ID NO: 171 of at least 88%. In an embodiment, the GH62 polypeptide has a sequence identity to SEQ ID NO: 171 of at least 89%. In an embodiment, the GH62 polypeptide has a sequence identity to SEQ ID NO: 171 of at least 90%. In an embodiment, the GH62 polypeptide has a sequence identity to SEQ ID NO: 171 of at least 91%. In an embodiment, the GH62 polypeptide has a sequence identity to SEQ ID NO: 171 of at least 92%. In an embodiment, the GH62 polypeptide has a sequence identity to SEQ ID NO: 171 of at least 93%. In an embodiment, the GH62 polypeptide has a sequence identity to SEQ ID NO: 171 of at least 94%. In an embodiment, the GH62 polypeptide has a sequence identity to SEQ ID NO: 171 of at least 95%. In an embodiment, the GH62 polypeptide has a sequence identity to SEQ ID NO: 171 of at least 96%. In an embodiment, the GH62 polypeptide has a sequence identity to SEQ ID NO: 171 of at least 97%. In an embodiment, the GH62 polypeptide has a sequence identity to SEQ ID NO: 171 of at least 98%. In an embodiment, the GH62 polypeptide has a sequence identity to SEQ ID NO: 171 of at least 99%.

In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of SEQ ID NO: 171. In one embodiment, the polypeptide preferably comprises or consists of the amino acid sequence of SEQ ID NO: 171 or an allelic variant thereof; comprises SEQ ID NO: 171 or an allelic variant thereof and a N-terminal and/or C-terminal His-tag and/or HQ-tag; or is a fragment thereof having arabinofuranosidase activity and having at least 90% of the length of SEQ ID NO: 171. In another embodiment, the polypeptide comprises or consists of amino acids 1 to 302 of SEQ ID NO: 171. In an embodiment, the polypeptide has been isolated.

In another embodiment, the composition comprises a GH62 polypeptide having arabinofuranosidase activity, wherein GH62 polypeptide having arabinofuranosidase activity has a sequence identity to the mature polypeptide of SEQ ID NO: 173 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%.

In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of the mature polypeptide of SEQ ID NO: 173. In one embodiment, the polypeptide preferably comprises or consists of the amino acid sequence of SEQ ID NO: 173 or an allelic variant thereof; comprises the amino acid sequence of SEQ ID NO: 173 and a N-terminal and/or C-terminal His-tag and/or HQ-tag; or is a fragment thereof having arabinofuranosidase activity and having at least 90% of the length of the mature polypeptide. In another embodiment, the polypeptide comprises or consists of the mature polypeptide of SEQ ID NO: 173. In another embodiment, the polypeptide comprises or consists of amino acids 1 to 364 of SEQ ID NO: 173. In an embodiment, the polypeptide has been isolated.

In an embodiment, the composition comprises a GH62 polypeptide having arabinofuranosidase activity having a sequence identity to SEQ ID NO: 174 of at least 80%. In an embodiment, the GH62 polypeptide has a sequence identity to SEQ ID NO: 174 of at least 85%. In an embodiment, the GH62 polypeptide has a sequence identity to SEQ ID NO: 174 of at least 86%. In an embodiment, the GH62 polypeptide has a sequence identity to SEQ ID NO: 174 of at least 87%. In an embodiment, the GH62 polypeptide has a sequence identity to SEQ ID NO: 174 of at least 88%. In an embodiment, the GH62 polypeptide has a sequence identity to SEQ ID NO: 174 of at least 89%. In an embodiment, the GH62 polypeptide has a sequence identity to SEQ ID NO: 174 of at least 90%. In an embodiment, the GH62 polypeptide has a sequence identity to SEQ ID NO: 174 of at least 91%. In an embodiment, the GH62 polypeptide has a sequence identity to SEQ ID NO: 174 of at least 92%. In an embodiment, the GH62 polypeptide has a sequence identity to SEQ ID NO: 174 of at least 93%. In an embodiment, the GH62 polypeptide has a sequence identity to SEQ ID NO: 174 of at least 94%. In an embodiment, the GH62 polypeptide has a sequence identity to SEQ ID NO: 174 of at least 95%. In an embodiment, the GH62 polypeptide has a sequence identity to SEQ ID NO: 174 of at least 96%. In an embodiment, the GH62 polypeptide has a sequence identity to SEQ ID NO: 174 of at least 97%. In an embodiment, the GH62 polypeptide has a sequence identity to SEQ ID NO: 174 of at least 98%. In an embodiment, the GH62 polypeptide has a sequence identity to SEQ ID NO: 174 of at least 99%.

In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of SEQ ID NO: 174. In one embodiment, the polypeptide preferably comprises or consists of the amino acid sequence of SEQ ID NO: 174 or an allelic variant thereof; comprises SEQ ID NO: 174 or an allelic variant thereof and a N-terminal and/or C-terminal His-tag and/or HQ-tag; or is a fragment thereof having arabinofuranosidase activity and having at least 90% of the length of SEQ ID NO: 174. In another embodiment, the polypeptide comprises or consists of amino acids 1 to 364 of SEQ ID NO: 174. In an embodiment, the polypeptide has been isolated.

GH10 and GH11 Polypeptides of the Composition

Preferred embodiments of the first aspect of the invention relating to the GH10 or GH11 polypeptide having xylanase activity are disclosed herein below.

In an embodiment, the composition comprises a GH10 polypeptide having xylanase activity such as the xylanase from *Aspergillus aculeatus* (Xyl II) as disclosed in WO 1994/021785 as SEQ ID NO: 5 and disclosed herein as SEQ ID NO: 70.

In an embodiment, the composition comprises a GH10 polypeptide having xylanase activity having a sequence identity to SEQ ID NO: 70 of at least 80%. In an embodiment, the GH10 polypeptide has a sequence identity to SEQ ID NO: 70 of at least 85%. In an embodiment, the GH10 polypeptide has a sequence identity to SEQ ID NO: 70 of at least 86%. In an embodiment, the GH10 polypeptide has a sequence identity to SEQ ID NO: 70 of at least 87%. In an embodiment, the GH10 polypeptide has a sequence identity to SEQ ID NO: 70 of at least 88%. In an embodiment, the GH10 polypeptide has a sequence identity to SEQ ID NO: 70 of at least 89%. In an embodiment, the GH10 polypeptide has a sequence identity to SEQ ID NO: 70 of at least 90%. In an embodiment, the GH10 polypeptide has a sequence identity to SEQ ID NO: 70 of at least 91%. In an embodiment, the GH10 polypeptide has a sequence identity to SEQ ID NO: 70 of at least 92%. In an embodiment, the GH10 polypeptide has a sequence identity to SEQ ID NO: 70 of at least 93%. In an embodiment, the GH10 polypeptide has a sequence identity to SEQ ID NO: 70 of at least 94%. In an embodiment, the GH10 polypeptide has a sequence identity to SEQ ID NO: 70 of at least 95%. In an embodiment, the GH10 polypeptide has a sequence identity to SEQ ID NO: 70 of at least 96%. In an embodiment, the GH10 polypeptide has a sequence identity to SEQ ID NO: 70 of at least 97%. In an embodiment, the GH10 polypeptide has a sequence identity to SEQ ID NO: 70 of at least 98%. In an embodiment, the GH10 polypeptide has a sequence identity to SEQ ID NO: 70 of at least 99%.

In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of SEQ ID NO: 70. In one embodiment, the polypeptide preferably comprises or consists of the amino acid sequence of SEQ ID NO: 70 or an allelic variant thereof; comprises SEQ ID NO: 70 or an allelic variant thereof and a N-terminal and/or C-terminal His-tag and/or HQ-tag; or is a fragment thereof having xylanase activity and having at least 90% of the length of SEQ ID NO: 70. In another embodiment, the polypeptide comprises or consists of amino acids 1 to 384 of SEQ ID NO: 70. In an embodiment, the polypeptide has been isolated.

In an embodiment, the composition comprises a GH10 polypeptide having xylanase activity such as the xylanase from *Clostridium acetobutylicum* as disclosed in *J. Bacteriol.* 2001, 183(16):4823 as Swissprot:Q97TP5 and disclosed herein as SEQ ID NO: 71.

In an embodiment, the composition comprises a GH10 polypeptide having xylanase activity having a sequence identity to SEQ ID NO: 71 of at least 80%. In an embodiment, the GH10 polypeptide has a sequence identity to SEQ ID NO: 71 of at least 85%. In an embodiment, the GH10 polypeptide has a sequence identity to SEQ ID NO: 71 of at least 86%. In an embodiment, the GH10 polypeptide has a sequence identity to SEQ ID NO: 71 of at least 87%. In an embodiment, the GH10 polypeptide has a sequence identity to SEQ ID NO: 71 of at least 88%. In an embodiment, the GH10 polypeptide has a sequence identity to SEQ ID NO: 71 of at least 89%. In an embodiment, the GH10 polypeptide has a sequence identity to SEQ ID NO: 71 of at least 90%. In an embodiment, the GH10 polypeptide has a sequence identity to SEQ ID NO: 71 of at least 91%. In an embodiment, the GH10 polypeptide has a sequence identity to SEQ ID NO: 71 of at least 92%. In an embodiment, the GH10 polypeptide has a sequence identity to SEQ ID NO: 71 of at least 93%. In an embodiment, the GH10 polypeptide has a sequence identity to SEQ ID NO: 71 of at least 94%. In an embodiment, the GH10 polypeptide has a sequence identity to SEQ ID NO: 71 of at least 95%. In an embodiment, the GH10 polypeptide has a sequence identity to SEQ ID NO: 71 of at least 96%. In an embodiment, the GH10 polypeptide has a sequence identity to SEQ ID NO: 71 of at least 97%. In an embodiment, the GH10 polypeptide has a sequence identity to SEQ ID NO: 71 of at least 98%. In an embodiment, the GH10 polypeptide has a sequence identity to SEQ ID NO: 71 of at least 99%.

In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of SEQ ID NO: 71. In one embodiment, the polypeptide preferably comprises or consists of the amino acid sequence of SEQ ID NO: 71 or an allelic variant thereof; comprises SEQ ID NO: 71 or an allelic variant thereof and a N-terminal and/or C-terminal His-tag and/or HQ-tag; or is a fragment thereof having xylanase activity and having at least 90% of the length of SEQ ID NO: 71. In another embodiment, the polypeptide comprises or consists of amino acids 1 to 288 of SEQ ID NO: 71. In an embodiment, the polypeptide has been isolated.

In an embodiment, the composition comprises a GH10 polypeptide having xylanase activity such as the xylanase from *Aspergillus aculeatus* as disclosed as SEQ ID NO: 8 in WO 2005/059084 and disclosed herein as SEQ ID NO: 72.

In an embodiment, the composition comprises a GH10 polypeptide having xylanase activity having a sequence identity to SEQ ID NO: 72 of at least 80%. In an embodiment, the GH10 polypeptide has a sequence identity to SEQ ID NO: 72 of at least 85%. In an embodiment, the GH10 polypeptide has a sequence identity to SEQ ID NO: 72 of at least 86%. In an embodiment, the GH10 polypeptide has a sequence identity to SEQ ID NO: 72 of at least 87%. In an embodiment, the GH10 polypeptide has a sequence identity to SEQ ID NO: 72 of at least 88%. In an embodiment, the GH10 polypeptide has a sequence identity to SEQ ID NO: 72 of at least 89%. In an embodiment, the GH10 polypeptide has a sequence identity to SEQ ID NO: 72 of at least 90%. In an embodiment, the GH10 polypeptide has a sequence identity to SEQ ID NO: 72 of at least 91%. In an embodiment, the GH10 polypeptide has a sequence identity to SEQ ID NO: 72 of at least 92%. In an embodiment, the GH10 polypeptide has a sequence identity to SEQ ID NO: 72 of at least 93%. In an embodiment, the GH10 polypeptide has a sequence identity to SEQ ID NO: 72 of at least 94%. In an embodiment, the GH10 polypeptide has a sequence identity to SEQ ID NO: 72 of at least 95%. In an embodiment, the GH10 polypeptide has a sequence identity to SEQ ID NO: 72 of at least 96%. In an embodiment, the GH10 polypeptide has a sequence identity to SEQ ID NO: 72 of at least 97%. In an embodiment, the GH10 polypeptide has a sequence identity to SEQ ID NO: 72 of at least 98%. In an embodiment, the GH10 polypeptide has a sequence identity to SEQ ID NO: 72 of at least 99%.

In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of SEQ ID NO: 72. In one embodiment, the polypeptide preferably comprises or consists of the amino acid sequence of SEQ ID NO: 72 or an allelic variant thereof; comprises SEQ ID NO: 72 or an allelic variant thereof and a N-terminal and/or C-terminal His-tag and/or HQ-tag; or is a fragment thereof having xylanase activity and having at least 90% of the length of SEQ ID NO: 72. In another embodiment, the polypeptide comprises or consists of amino acids 1 to 308 of SEQ ID NO: 72. In an embodiment, the polypeptide has been isolated.

In an embodiment, the composition comprises a GH11 polypeptide having xylanase activity such as the xylanase from *Thermomyces lanuginosus* as disclosed as SEQ ID NO: 2 in WO1996/23062 and disclosed herein as SEQ ID NO: 73.

In an embodiment, the composition comprises a GH10 polypeptide having xylanase activity having a sequence identity to SEQ ID NO: 73 of at least 80%. In an embodiment, the GH10 polypeptide has a sequence identity to SEQ ID NO: 73 of at least 85%. In an embodiment, the GH10 polypeptide has a sequence identity to SEQ ID NO: 73 of at least 86%. In an embodiment, the GH10 polypeptide has a sequence identity to SEQ ID NO: 73 of at least 87%. In an embodiment, the GH10 polypeptide has a sequence identity to SEQ ID NO: 73 of at least 88%. In an embodiment, the GH10 polypeptide has a sequence identity to SEQ ID NO:

73 of at least 89%. In an embodiment, the GH10 polypeptide has a sequence identity to SEQ ID NO: 73 of at least 90%. In an embodiment, the GH10 polypeptide has a sequence identity to SEQ ID NO: 73 of at least 91%. In an embodiment, the GH10 polypeptide has a sequence identity to SEQ ID NO: 73 of at least 92%. In an embodiment, the GH10 polypeptide has a sequence identity to SEQ ID NO: 73 of at least 93%. In an embodiment, the GH10 polypeptide has a sequence identity to SEQ ID NO: 73 of at least 94%. In an embodiment, the GH10 polypeptide has a sequence identity to SEQ ID NO: 73 of at least 95%. In an embodiment, the GH10 polypeptide has a sequence identity to SEQ ID NO: 73 of at least 96%. In an embodiment, the GH10 polypeptide has a sequence identity to SEQ ID NO: 73 of at least 97%. In an embodiment, the GH10 polypeptide has a sequence identity to SEQ ID NO: 73 of at least 98%. In an embodiment, the GH10 polypeptide has a sequence identity to SEQ ID NO: 73 of at least 99%.

In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of SEQ ID NO: 73. In one embodiment, the polypeptide preferably comprises or consists of the amino acid sequence of SEQ ID NO: 73 or an allelic variant thereof; comprises SEQ ID NO: 73 or an allelic variant thereof and a N-terminal and/or C-terminal His-tag and/or HQ-tag; or is a fragment thereof having xylanase activity and having at least 90% of the length of SEQ ID NO: 73. In another embodiment, the polypeptide comprises or consists of amino acids 1 to 195 of SEQ ID NO: 73. In an embodiment, the polypeptide has been isolated.

In an embodiment, the composition comprises a GH11 polypeptide having xylanase activity such as the xylanase from *Dictyoglomus thermophilum* as disclosed as SEQ ID NO: 305 in WO2011/057140 and disclosed herein as SEQ ID NO: 74.

In an embodiment, the composition comprises a GH10 polypeptide having xylanase activity having a sequence identity to SEQ ID NO: 74 of at least 80%. In an embodiment, the GH10 polypeptide has a sequence identity to SEQ ID NO: 74 of at least 85%. In an embodiment, the GH10 polypeptide has a sequence identity to SEQ ID NO: 74 of at least 86%. In an embodiment, the GH10 polypeptide has a sequence identity to SEQ ID NO: 74 of at least 87%. In an embodiment, the GH10 polypeptide has a sequence identity to SEQ ID NO: 74 of at least 88%. In an embodiment, the GH10 polypeptide has a sequence identity to SEQ ID NO: 74 of at least 89%. In an embodiment, the GH10 polypeptide has a sequence identity to SEQ ID NO: 74 of at least 90%. In an embodiment, the GH10 polypeptide has a sequence identity to SEQ ID NO: 74 of at least 91%. In an embodiment, the GH10 polypeptide has a sequence identity to SEQ ID NO: 74 of at least 92%. In an embodiment, the GH10 polypeptide has a sequence identity to SEQ ID NO: 74 of at least 93%. In an embodiment, the GH10 polypeptide has a sequence identity to SEQ ID NO: 74 of at least 94%. In an embodiment, the GH10 polypeptide has a sequence identity to SEQ ID NO: 74 of at least 95%. In an embodiment, the GH10 polypeptide has a sequence identity to SEQ ID NO: 74 of at least 96%. In an embodiment, the GH10 polypeptide has a sequence identity to SEQ ID NO: 74 of at least 97%. In an embodiment, the GH10 polypeptide has a sequence identity to SEQ ID NO: 74 of at least 98%. In an embodiment, the GH10 polypeptide has a sequence identity to SEQ ID NO: 74 of at least 99%.

In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of SEQ ID NO: 74. In one embodiment, the polypeptide preferably comprises or consists of the amino acid sequence of SEQ ID NO: 74 or an allelic variant thereof; comprises SEQ ID NO: 74 or an allelic variant thereof and a N-terminal and/or C-terminal His-tag and/or HQ-tag; or is a fragment thereof having xylanase activity and having at least 90% of the length of SEQ ID NO: 74. In another embodiment, the polypeptide comprises or consists of amino acids 1 to 203 of SEQ ID NO: 74. In an embodiment, the polypeptide has been isolated.

In an embodiment, the composition comprises a GH11 polypeptide having xylanase activity such as the xylanase from *Paenibacillus Pabuli* as disclosed as SEQ ID NO: 2 in WO2005/079585 and disclosed herein as SEQ ID NO: 75.

In an embodiment, the composition comprises a GH10 polypeptide having xylanase activity having a sequence identity to SEQ ID NO: 75 of at least 80%. In an embodiment, the GH10 polypeptide has a sequence identity to SEQ ID NO: 75 of at least 85%. In an embodiment, the GH10 polypeptide has a sequence identity to SEQ ID NO: 75 of at least 86%. In an embodiment, the GH10 polypeptide has a sequence identity to SEQ ID NO: 75 of at least 87%. In an embodiment, the GH10 polypeptide has a sequence identity to SEQ ID NO: 75 of at least 88%. In an embodiment, the GH10 polypeptide has a sequence identity to SEQ ID NO: 75 of at least 89%. In an embodiment, the GH10 polypeptide has a sequence identity to SEQ ID NO: 75 of at least 90%. In an embodiment, the GH10 polypeptide has a sequence identity to SEQ ID NO: 75 of at least 91%. In an embodiment, the GH10 polypeptide has a sequence identity to SEQ ID NO: 75 of at least 92%. In an embodiment, the GH10 polypeptide has a sequence identity to SEQ ID NO: 75 of at least 93%. In an embodiment, the GH10 polypeptide has a sequence identity to SEQ ID NO: 75 of at least 94%. In an embodiment, the GH10 polypeptide has a sequence identity to SEQ ID NO: 75 of at least 95%. In an embodiment, the GH10 polypeptide has a sequence identity to SEQ ID NO: 75 of at least 96%. In an embodiment, the GH10 polypeptide has a sequence identity to SEQ ID NO: 75 of at least 97%. In an embodiment, the GH10 polypeptide has a sequence identity to SEQ ID NO: 75 of at least 98%. In an embodiment, the GH10 polypeptide has a sequence identity to SEQ ID NO: 75 of at least 99%.

In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of SEQ ID NO: 75. In one embodiment, the polypeptide preferably comprises or consists of the amino acid sequence of SEQ ID NO: 75 or an allelic variant thereof; comprises SEQ ID NO: 75 or an allelic variant thereof and a N-terminal and/or C-terminal His-tag and/or HQ-tag; or is a fragment thereof having xylanase activity and having at least 90% of the length of SEQ ID NO: 75. In another embodiment, the polypeptide comprises or consists of amino acids 1 to 182 of SEQ ID NO: 75. In an embodiment, the polypeptide has been isolated.

In an embodiment, the composition comprises a GH11 polypeptide having xylanase activity such as the xylanase from *Geobacillus stearothermophilus* as disclosed herein as SEQ ID NO: 78. In an embodiment, the composition comprises a GH10 polypeptide having xylanase activity having a sequence identity to the mature polypeptide of SEQ ID NO: 77 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%.

In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of the mature polypeptide of SEQ ID NO: 77. In one embodiment, the polypeptide preferably comprises or consists of the amino acid sequence of SEQ ID NO: 77 or an allelic variant thereof; comprises the amino acid sequence of SEQ ID NO: 77 and a N-terminal and/or C-terminal His-tag and/or HQ-tag such as the mature polypeptide of SEQ ID NO: 80 or SEQ ID NO: 81; or is a fragment thereof having xylanase activity and having at least 90% of the length of the mature polypeptide. In another embodiment, the polypeptide comprises or consists of the mature polypeptide of SEQ ID NO: 77. In another embodiment, the polypeptide comprises or consists of amino acids 1 to 183 of SEQ ID NO: 77. In another embodiment, the polypeptide comprises or consists of the mature polypeptide of SEQ ID NO: 80. In another embodiment, the polypeptide comprises or consists of amino acids 1 to 181 of SEQ ID NO: 80. In an embodiment, the polypeptide has been isolated.

In an embodiment, the composition comprises a GH10 polypeptide having xylanase activity having a sequence identity to SEQ ID NO: 78 of at least 80%. In an embodiment, the GH10 polypeptide has a sequence identity to SEQ ID NO: 78 of at least 85%. In an embodiment, the GH10 polypeptide has a sequence identity to SEQ ID NO: 78 of at least 86%. In an embodiment, the GH10 polypeptide has a sequence identity to SEQ ID NO: 78 of at least 87%. In an embodiment, the GH10 polypeptide has a sequence identity to SEQ ID NO: 78 of at least 88%. In an embodiment, the GH10 polypeptide has a sequence identity to SEQ ID NO: 78 of at least 89%. In an embodiment, the GH10 polypeptide has a sequence identity to SEQ ID NO: 78 of at least 90%. In an embodiment, the GH10 polypeptide has a sequence identity to SEQ ID NO: 78 of at least 91%. In an embodiment, the GH10 polypeptide has a sequence identity to SEQ ID NO: 78 of at least 92%. In an embodiment, the GH10 polypeptide has a sequence identity to SEQ ID NO: 78 of at least 93%. In an embodiment, the GH10 polypeptide has a sequence identity to SEQ ID NO: 78 of at least 94%. In an embodiment, the GH10 polypeptide has a sequence identity to SEQ ID NO: 78 of at least 95%. In an embodiment, the GH10 polypeptide has a sequence identity to SEQ ID NO: 78 of at least 96%. In an embodiment, the GH10 polypeptide has a sequence identity to SEQ ID NO: 78 of at least 97%. In an embodiment, the GH10 polypeptide has a sequence identity to SEQ ID NO: 78 of at least 98%. In an embodiment, the GH10 polypeptide has a sequence identity to SEQ ID NO: 78 of at least 99%.

In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of SEQ ID NO: 78. In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of SEQ ID NO: 81. In one embodiment, the polypeptide preferably comprises or consists of the amino acid sequence of SEQ ID NO: 78 or an allelic variant thereof; comprises SEQ ID NO: 78 or an allelic variant thereof and a N-terminal and/or C-terminal His-tag and/or HQ-tag such as SEQ ID NO: 81; or is a fragment thereof having xylanase activity and having at least 90% of the length of SEQ ID NO: 78. In another embodiment, the polypeptide comprises or consists of amino acids 1 to 183 of SEQ ID NO: 78. In another embodiment, the polypeptide comprises or consists of amino acids 1 to 181 of SEQ ID NO: 81. In an embodiment, the polypeptide has been isolated.

In an embodiment, the composition comprises a GH11 polypeptide having xylanase activity such as the xylanase from Streptomyces beijiangensis as disclosed herein as SEQ ID NO: 84. In an embodiment, the composition comprises a GH10 polypeptide having xylanase activity having a sequence identity to the mature polypeptide of SEQ ID NO: 83 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%.

In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of the mature polypeptide of SEQ ID NO: 83. In one embodiment, the polypeptide preferably comprises or consists of the amino acid sequence of SEQ ID NO: 83 or an allelic variant thereof; comprises the amino acid sequence of SEQ ID NO: 83 and a N-terminal and/or C-terminal His-tag and/or HQ-tag such as the mature polypeptide of SEQ ID NO: 86 or SEQ ID NO: 87; or is a fragment thereof having xylanase activity and having at least 90% of the length of the mature polypeptide. In another embodiment, the polypeptide comprises or consists of the mature polypeptide of SEQ ID NO: 83. In another embodiment, the polypeptide comprises or consists of amino acids 1 to 299 of SEQ ID NO: 83. In another embodiment, the polypeptide comprises or consists of the mature polypeptide of SEQ ID NO: 86. In another embodiment, the polypeptide comprises or consists of amino acids 1 to 307 of SEQ ID NO: 86. In an embodiment, the polypeptide has been isolated.

In an embodiment, the composition comprises a GH10 polypeptide having xylanase activity having a sequence identity to SEQ ID NO: 84 of at least 80%. In an embodiment, the GH10 polypeptide has a sequence identity to SEQ ID NO: 84 of at least 85%. In an embodiment, the GH10 polypeptide has a sequence identity to SEQ ID NO: 84 of at least 86%. In an embodiment, the GH10 polypeptide has a sequence identity to SEQ ID NO: 84 of at least 87%. In an embodiment, the GH10 polypeptide has a sequence identity to SEQ ID NO: 84 of at least 88%. In an embodiment, the GH10 polypeptide has a sequence identity to SEQ ID NO: 84 of at least 89%. In an embodiment, the GH10 polypeptide has a sequence identity to SEQ ID NO: 84 of at least 90%. In an embodiment, the GH10 polypeptide has a sequence identity to SEQ ID NO: 84 of at least 91%. In an embodiment, the GH10 polypeptide has a sequence identity to SEQ ID NO: 84 of at least 92%. In an embodiment, the GH10 polypeptide has a sequence identity to SEQ ID NO: 84 of at least 93%. In an embodiment, the GH10 polypeptide has a sequence identity to SEQ ID NO: 84 of at least 94%. In an embodiment, the GH10 polypeptide has a sequence identity to SEQ ID NO: 84 of at least 95%. In an embodiment, the GH10 polypeptide has a sequence identity to SEQ ID NO: 84 of at least 96%. In an embodiment, the GH10 polypeptide has a sequence identity to SEQ ID NO: 84 of at least 97%. In an embodiment, the GH10 polypeptide has a sequence identity to SEQ ID NO: 84 of at least 98%. In an embodiment, the GH10 polypeptide has a sequence identity to SEQ ID NO: 84 of at least 99%.

In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of SEQ ID NO: 84. In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of SEQ ID NO: 87. In one embodiment, the polypeptide preferably comprises or consists of the amino acid sequence of SEQ ID NO: 84 or an allelic variant thereof; comprises SEQ ID NO: 84 or an allelic variant thereof and a N-terminal and/or C-terminal His-tag and/or HQ-tag such as SEQ ID NO: 87; or is a fragment thereof having xylanase activity and having at least 90% of the length of SEQ ID NO: 84. In another embodiment, the polypeptide comprises or consists of amino acids 1 to 299 of SEQ ID NO: 84. In another embodiment, the polypeptide comprises or consists of amino acids 1 to 307 of SEQ ID NO: 87. In an embodiment, the polypeptide has been isolated.

In an embodiment, the composition comprises a GH11 polypeptide having xylanase activity such as the xylanase from *Fusarium oxysporum* called FoxXyn6 as disclosed as SEQ ID NO: 2 in WO2014/019220 and as disclosed herein as SEQ ID NO: 88.

In an embodiment, the composition comprises a GH10 polypeptide having xylanase activity having a sequence identity to SEQ ID NO: 88 of at least 80%. In an embodiment, the GH10 polypeptide has a sequence identity to SEQ ID NO: 88 of at least 85%. In an embodiment, the GH10 polypeptide has a sequence identity to SEQ ID NO: 88 of at least 86%. In an embodiment, the GH10 polypeptide has a sequence identity to SEQ ID NO: 88 of at least 87%. In an embodiment, the GH10 polypeptide has a sequence identity to SEQ ID NO: 88 of at least 88%. In an embodiment, the GH10 polypeptide has a sequence identity to SEQ ID NO: 88 of at least 89%. In an embodiment, the GH10 polypeptide has a sequence identity to SEQ ID NO: 88 of at least 90%. In an embodiment, the GH10 polypeptide has a sequence identity to SEQ ID NO: 88 of at least 91%. In an embodiment, the GH10 polypeptide has a sequence identity to SEQ ID NO: 88 of at least 92%. In an embodiment, the GH10 polypeptide has a sequence identity to SEQ ID NO: 88 of at least 93%. In an embodiment, the GH10 polypeptide has a sequence identity to SEQ ID NO: 88 of at least 94%. In an embodiment, the GH10 polypeptide has a sequence identity to SEQ ID NO: 88 of at least 95%. In an embodiment, the GH10 polypeptide has a sequence identity to SEQ ID NO: 88 of at least 96%. In an embodiment, the GH10 polypeptide has a sequence identity to SEQ ID NO: 88 of at least 97%. In an embodiment, the GH10 polypeptide has a sequence identity to SEQ ID NO: 88 of at least 98%. In an embodiment, the GH10 polypeptide has a sequence identity to SEQ ID NO: 88 of at least 99%.

In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of SEQ ID NO: 88. In one embodiment, the polypeptide preferably comprises or consists of the amino acid sequence of SEQ ID NO: 88 or an allelic variant thereof; comprises SEQ ID NO: 88 or an allelic variant thereof and a N-terminal and/or C-terminal His-tag and/or HQ-tag; or is a fragment thereof having xylanase activity and having at least 90% of the length of SEQ ID NO: 88. In another embodiment, the polypeptide comprises or consists of amino acids 1 to 188 of SEQ ID NO: 88. In an embodiment, the polypeptide has been isolated.

In an embodiment, the composition comprises a GH11 polypeptide having xylanase activity such as the xylanase from *Fusarium oxysporum* called AclXyn5 as disclosed as SEQ ID NO: 7 in WO2014/020143 and as disclosed herein as SEQ ID NO: 89.

In an embodiment, the composition comprises a GH10 polypeptide having xylanase activity having a sequence identity to SEQ ID NO: 89 of at least 80%. In an embodiment, the GH10 polypeptide has a sequence identity to SEQ ID NO: 89 of at least 85%. In an embodiment, the GH10 polypeptide has a sequence identity to SEQ ID NO: 89 of at least 86%. In an embodiment, the GH10 polypeptide has a sequence identity to SEQ ID NO: 89 of at least 87%. In an embodiment, the GH10 polypeptide has a sequence identity to SEQ ID NO: 89 of at least 88%. In an embodiment, the GH10 polypeptide has a sequence identity to SEQ ID NO: 89 of at least 89%. In an embodiment, the GH10 polypeptide has a sequence identity to SEQ ID NO: 89 of at least 90%. In an embodiment, the GH10 polypeptide has a sequence identity to SEQ ID NO: 89 of at least 91%. In an embodiment, the GH10 polypeptide has a sequence identity to SEQ ID NO: 89 of at least 92%. In an embodiment, the GH10 polypeptide has a sequence identity to SEQ ID NO: 89 of at least 93%. In an embodiment, the GH10 polypeptide has a sequence identity to SEQ ID NO: 89 of at least 94%. In an embodiment, the GH10 polypeptide has a sequence identity to SEQ ID NO: 89 of at least 95%. In an embodiment, the GH10 polypeptide has a sequence identity to SEQ ID NO: 89 of at least 96%. In an embodiment, the GH10 polypeptide has a sequence identity to SEQ ID NO: 89 of at least 97%. In an embodiment, the GH10 polypeptide has a sequence identity to SEQ ID NO: 89 of at least 98%. In an embodiment, the GH10 polypeptide has a sequence identity to SEQ ID NO: 89 of at least 99%.

In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of SEQ ID NO: 89. In one embodiment, the polypeptide preferably comprises or consists of the amino acid sequence of SEQ ID NO: 89 or an allelic variant thereof; comprises SEQ ID NO: 89 or an allelic variant thereof and a N-terminal and/or C-terminal His-tag and/or HQ-tag; or is a fragment thereof having xylanase activity and having at least 90% of the length of SEQ ID NO: 89. In another embodiment, the polypeptide comprises or consists of amino acids 1 to 189 of SEQ ID NO: 89. In an embodiment, the polypeptide has been isolated.

In an embodiment, the composition comprises a GH10 polypeptide having xylanase activity such as the xylanase from *Thermotoga maritima* MSB8 called XynB as disclosed as SEQ ID NO: 1 in WO2013/068550 and as disclosed herein as SEQ ID NO: 95.

In an embodiment, the composition comprises a GH10 polypeptide having xylanase activity having a sequence identity to SEQ ID NO: 95 of at least 80%. In an embodiment, the GH10 polypeptide has a sequence identity to SEQ ID NO: 95 of at least 85%. In an embodiment, the GH10 polypeptide has a sequence identity to SEQ ID NO: 95 of at least 86%. In an embodiment, the GH10 polypeptide has a sequence identity to SEQ ID NO: 95 of at least 87%. In an embodiment, the GH10 polypeptide has a sequence identity to SEQ ID NO: 95 of at least 88%. In an embodiment, the GH10 polypeptide has a sequence identity to SEQ ID NO: 95 of at least 89%. In an embodiment, the GH10 polypeptide has a sequence identity to SEQ ID NO: 95 of at least 90%. In an embodiment, the GH10 polypeptide has a sequence identity to SEQ ID NO: 95 of at least 91%. In an embodiment, the GH10 polypeptide has a sequence identity to SEQ ID NO: 95 of at least 92%. In an embodiment, the GH10 polypeptide has a sequence identity to SEQ ID NO: 95 of at least 93%. In an embodiment, the GH10 polypeptide has a sequence identity to SEQ ID NO: 95 of at least 94%. In an embodiment, the GH10 polypeptide has a sequence identity to SEQ ID NO: 95 of at least 95%. In an embodiment, the GH10 polypeptide has a sequence identity to SEQ ID NO: 95 of at least 96%. In an embodiment, the GH10 polypeptide has a sequence identity to SEQ ID NO: 95 of at least 97%. In an embodiment, the GH10 polypeptide has a sequence identity to SEQ ID NO: 95 of at least 98%. In an embodiment, the GH10 polypeptide has a sequence identity to SEQ ID NO: 95 of at least 99%.

In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of SEQ ID NO: 95. In one embodiment, the polypeptide preferably comprises or consists of the amino acid sequence of SEQ ID NO: 95 or an allelic variant thereof; comprises SEQ ID NO: 95 or an allelic variant thereof and a N-terminal and/or C-terminal His-tag and/or HQ-tag; or is a fragment thereof having xylanase activity and having at least 90% of the length of SEQ ID NO: 95. In another embodiment, the polypeptide comprises or consists of amino acids 1 to 328 of SEQ ID NO: 95. In an embodiment, the polypeptide has been isolated.

In an embodiment, the composition comprises a GH11 polypeptide having xylanase activity such as the xylanase from *Myceliophthora thermophila* called Xyl6 as disclosed as SEQ ID NO: 41 in WO2009/018537 and as disclosed herein as SEQ ID NO: 96.

In an embodiment, the composition comprises a GH11 polypeptide having xylanase activity having a sequence identity to SEQ ID NO: 96 of at least 80%. In an embodiment, the GH11 polypeptide has a sequence identity to SEQ ID NO: 96 of at least 85%. In an embodiment, the GH11 polypeptide has a sequence identity to SEQ ID NO: 96 of at least 86%. In an embodiment, the GH11 polypeptide has a sequence identity to SEQ ID NO: 96 of at least 87%. In an embodiment, the GH11 polypeptide has a sequence identity to SEQ ID NO: 96 of at least 88%. In an embodiment, the GH11 polypeptide has a sequence identity to SEQ ID NO: 96 of at least 89%. In an embodiment, the GH11 polypeptide has a sequence identity to SEQ ID NO: 96 of at least 90%. In an embodiment, the GH11 polypeptide has a sequence identity to SEQ ID NO: 96 of at least 91%. In an embodiment, the GH11 polypeptide has a sequence identity to SEQ ID NO: 96 of at least 92%. In an embodiment, the GH11 polypeptide has a sequence identity to SEQ ID NO: 96 of at least 93%. In an embodiment, the GH11 polypeptide has a sequence identity to SEQ ID NO: 96 of at least 94%. In an embodiment, the GH11 polypeptide has a sequence identity to SEQ ID NO: 96 of at least 95%. In an embodiment, the GH11 polypeptide has a sequence identity to SEQ ID NO: 96 of at least 96%. In an embodiment, the GH11 polypeptide has a sequence identity to SEQ ID NO: 96 of at least 97%. In an embodiment, the GH11 polypeptide has a sequence identity to SEQ ID NO: 96 of at least 98%. In an embodiment, the GH11 polypeptide has a sequence identity to SEQ ID NO: 96 of at least 99%.

In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of SEQ ID NO: 96. In one embodiment, the polypeptide preferably comprises or consists of the amino acid sequence of SEQ ID NO: 96 or an allelic variant thereof; comprises SEQ ID NO: 96 or an allelic variant thereof and a N-terminal and/or C-terminal His-tag and/or HQ-tag; or is a fragment thereof having xylanase activity and having at least 90% of the length of SEQ ID NO: 96. In another embodiment, the polypeptide comprises or consists of amino acids 1 to 208 of SEQ ID NO: 96. In an embodiment, the polypeptide has been isolated.

In an embodiment, the composition comprises a GH11 polypeptide having xylanase activity, wherein GH11 polypeptide having xylanase activity has a sequence identity to the mature polypeptide of SEQ ID NO: 98 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%.

In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of the mature polypeptide of SEQ ID NO: 98. In one embodiment, the polypeptide preferably comprises or consists of the amino acid sequence of SEQ ID NO: 98 or an allelic variant thereof; comprises the amino acid sequence of SEQ ID NO: 98 and a N-terminal and/or C-terminal His-tag and/or HQ-tag; or is a fragment thereof having xylanase activity and having at least 90% of the length of the mature polypeptide. In another embodiment, the polypeptide comprises or consists of the mature polypeptide of SEQ ID NO: 98. In another embodiment, the polypeptide comprises or consists of amino acids 1 to 203 of SEQ ID NO: 98. In an embodiment, the polypeptide has been isolated.

In an embodiment, the composition comprises a GH11 polypeptide having xylanase activity having a sequence identity to SEQ ID NO: 99 of at least 80%. In an embodiment, the GH11 polypeptide has a sequence identity to SEQ ID NO: 99 of at least 85%. In an embodiment, the GH11 polypeptide has a sequence identity to SEQ ID NO: 99 of at least 86%. In an embodiment, the GH11 polypeptide has a sequence identity to SEQ ID NO: 99 of at least 87%. In an embodiment, the GH11 polypeptide has a sequence identity to SEQ ID NO: 99 of at least 88%. In an embodiment, the GH11 polypeptide has a sequence identity to SEQ ID NO: 99 of at least 89%. In an embodiment, the GH11 polypeptide has a sequence identity to SEQ ID NO: 99 of at least 90%. In an embodiment, the GH11 polypeptide has a sequence identity to SEQ ID NO: 99 of at least 91%. In an embodiment, the GH11 polypeptide has a sequence identity to SEQ ID NO: 99 of at least 92%. In an embodiment, the GH11 polypeptide has a sequence identity to SEQ ID NO: 99 of at least 93%. In an embodiment, the GH11 polypeptide has a sequence identity to SEQ ID NO: 99 of at least 94%. In an embodiment, the GH11 polypeptide has a sequence identity to SEQ ID NO: 99 of at least 95%. In an embodiment, the GH11 polypeptide has a sequence identity to SEQ ID NO: 99 of at least 96%. In an embodiment, the GH11 polypeptide has a sequence identity to SEQ ID NO: 99 of at least 97%. In an embodiment, the GH11 polypeptide has a sequence identity to SEQ ID NO: 99 of at least 98%. In an embodiment, the GH11 polypeptide has a sequence identity to SEQ ID NO: 99 of at least 99%.

In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of SEQ ID NO: 99. In one embodiment, the polypeptide preferably comprises or consists of the amino acid sequence of SEQ ID NO: 99 or an allelic variant thereof; comprises SEQ ID NO: 99 or an allelic variant thereof and a N-terminal and/or C-terminal His-tag and/or HQ-tag; or is a fragment thereof having xylanase activity and having at least 90% of the length of SEQ ID NO: 99. In another embodiment, the polypeptide comprises or consists of amino acids 1 to 203 of SEQ ID NO: 99. In an embodiment, the polypeptide has been isolated.

In an embodiment, the composition comprises a GH10 polypeptide having xylanase activity, wherein GH10 polypeptide having xylanase activity has a sequence identity to the mature polypeptide of SEQ ID NO: 101 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%.

In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of the mature polypeptide of SEQ ID NO: 101. In one embodiment, the polypeptide preferably comprises or consists of the amino acid sequence of SEQ ID NO: 101 or an allelic variant thereof; comprises the amino acid sequence of SEQ ID NO: 101 and a N-terminal and/or C-terminal His-tag and/or HQ-tag; or is a fragment thereof having xylanase activity and having at least 90% of the length of the mature polypeptide. In another embodiment, the polypeptide comprises or consists of the mature polypeptide of SEQ ID NO: 101. In another embodiment, the polypeptide comprises or consists of amino acids 1 to 337 of SEQ ID NO: 101. In an embodiment, the polypeptide has been isolated.

In an embodiment, the composition comprises a GH10 polypeptide having xylanase activity having a sequence identity to SEQ ID NO: 102 of at least 80%. In an embodiment, the GH10 polypeptide has a sequence identity to SEQ ID NO: 102 of at least 85%. In an embodiment, the GH10 polypeptide has a sequence identity to SEQ ID NO: 102 of at least 86%. In an embodiment, the GH10 polypeptide has a sequence identity to SEQ ID NO: 102 of at least 87%. In an embodiment, the GH10 polypeptide has a sequence identity to SEQ ID NO: 102 of at least 88%. In an embodiment, the GH10 polypeptide has a sequence identity to SEQ ID NO: 102 of at least 89%. In an embodiment, the GH10 polypeptide has a sequence identity to SEQ ID NO: 102 of at least 90%. In an embodiment, the GH10 polypeptide has a sequence identity to SEQ ID NO: 102 of at least 91%. In an embodiment, the GH10 polypeptide has a sequence identity to SEQ ID NO: 102 of at least 92%. In an embodiment, the GH10 polypeptide has a sequence identity to SEQ ID NO: 102 of at least 93%. In an embodiment, the GH10 polypeptide has a sequence identity to SEQ ID NO: 102 of at least 94%. In an embodiment, the GH10 polypeptide has a sequence identity to SEQ ID NO: 102 of at least 95%. In an embodiment, the GH10 polypeptide has a sequence identity to SEQ ID NO: 102 of at least 96%. In an embodiment, the GH10 polypeptide has a sequence identity to SEQ ID NO: 102 of at least 97%. In an embodiment, the GH10 polypeptide has a sequence identity to SEQ ID NO: 102 of at least 98%. In an embodiment, the GH10 polypeptide has a sequence identity to SEQ ID NO: 102 of at least 99%.

In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of SEQ ID NO: 102. In one embodiment, the polypeptide preferably comprises or consists of the amino acid sequence of SEQ ID NO: 102 or an allelic variant thereof; comprises SEQ ID NO: 102 or an allelic variant thereof and a N-terminal and/or C-terminal His-tag and/or HQ-tag; or is a fragment thereof having xylanase activity and having at least 90% of the length of SEQ ID NO: 102. In another embodiment, the polypeptide comprises or consists of amino acids 1 to 337 of SEQ ID NO: 102. In an embodiment, the polypeptide has been isolated.

In an embodiment, the composition comprises a GH10 polypeptide having xylanase activity such as the xylanase from *Ustilago maydis* as disclosed in *Fungal Genetics and Biology* 29, 145-151 (2000) and disclosed herein as SEQ ID NO: 177. In an embodiment, the composition comprises a GH10 polypeptide having xylanase activity having a sequence identity to the mature polypeptide of SEQ ID NO: 176 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%.

In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of the mature polypeptide of SEQ ID NO: 176. In one embodiment, the polypeptide preferably comprises or consists of the amino acid sequence of SEQ ID NO: 176 or an allelic variant thereof; comprises the amino acid sequence of SEQ ID NO: 176 and a N-terminal and/or C-terminal His-tag and/or HQ-tag such as the mature polypeptide of SEQ ID NO: 179 or SEQ ID NO: 180; or is a fragment thereof having xylanase activity and having at least 90% of the length of the mature polypeptide. In another embodiment, the polypeptide comprises or consists of the mature polypeptide of SEQ ID NO: 176. In another embodiment, the polypeptide comprises or consists of amino acids 1 to 323 of SEQ ID NO: 176. In another embodiment, the polypeptide comprises or consists of the mature polypeptide of SEQ ID NO: 179. In another embodiment, the polypeptide comprises or consists of amino acids 1 to 331 of SEQ ID NO: 179. In an embodiment, the polypeptide has been isolated.

In an embodiment, the composition comprises a GH10 polypeptide having xylanase activity having a sequence identity to SEQ ID NO: 177 of at least 80%. In an embodiment, the GH10 polypeptide has a sequence identity to SEQ ID NO: 177 of at least 85%. In an embodiment, the GH10 polypeptide has a sequence identity to SEQ ID NO: 177 of at least 86%. In an embodiment, the GH10 polypeptide has a sequence identity to SEQ ID NO: 177 of at least 87%. In an embodiment, the GH10 polypeptide has a sequence identity to SEQ ID NO: 177 of at least 88%. In an embodiment, the GH10 polypeptide has a sequence identity to SEQ ID NO: 177 of at least 89%. In an embodiment, the GH10 polypeptide has a sequence identity to SEQ ID NO: 177 of at least 90%. In an embodiment, the GH10 polypeptide has a sequence identity to SEQ ID NO: 177 of at least 91%. In an embodiment, the GH10 polypeptide has a sequence identity to SEQ ID NO: 177 of at least 92%. In an embodiment, the GH10 polypeptide has a sequence identity to SEQ ID NO: 177 of at least 93%. In an embodiment, the GH10 polypeptide has a sequence identity to SEQ ID NO: 177 of at least 94%. In an embodiment, the GH10 polypeptide has a sequence identity to SEQ ID NO: 177 of at least 95%. In an embodiment, the GH10 polypeptide has a sequence identity to SEQ ID NO: 177 of at least 96%. In an embodiment, the GH10 polypeptide has a sequence identity to SEQ ID NO: 177 of at least 97%. In an embodiment, the GH10 polypeptide has a sequence identity to SEQ ID NO: 177 of at least 98%. In an embodiment, the GH10 polypeptide has a sequence identity to SEQ ID NO: 177 of at least 99%.

In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of SEQ ID NO: 177. In one embodiment, the polypeptide comprises one or more amino acid substitutions, and/or one or more amino acid deletions, and/or one or more amino acid insertions or any combination thereof in between 1 and 10 positions, such as 1, 2, 3, 4, 5, 6, 7, 8, 9 or 10 positions of SEQ ID NO: 180. In one embodiment, the polypeptide preferably comprises or consists of the amino acid sequence of SEQ ID NO: 177 or an allelic variant thereof; comprises SEQ ID NO: 177 or an allelic variant thereof and a N-terminal and/or C-terminal His-tag and/or HQ-tag such as SEQ ID NO: 180; or is a fragment thereof having xylanase activity and having at least 90% of the length of SEQ ID NO: 177. In another embodiment, the polypeptide comprises or consists of amino acids 1 to 323 of SEQ ID NO: 177. In another embodiment, the polypeptide comprises or consists of amino acids 1 to 331 of SEQ ID NO: 180. In an embodiment, the polypeptide has been isolated.

Combinations

In the following paragraphs, specific combinations of GH10 or GH11 polypeptides having xylanase activity and GH62 polypeptides having arabinofuranosidase activity of the first aspect of the invention are listed.

In an embodiment, the composition of the invention comprises the GH62 polypeptide of SEQ ID NO: 9 and the GH10 polypeptide of SEQ ID NO: 70. In an embodiment, the composition of the invention comprises the GH62 polypeptide of SEQ ID NO: 9 and the GH10 polypeptide of SEQ ID NO: 71. In an embodiment, the composition of the invention comprises the GH62 polypeptide of SEQ ID NO: 9 and the GH10 polypeptide of SEQ ID NO: 72. In an embodiment, the composition of the invention comprises the GH62 polypeptide of SEQ ID NO: 9 and the GH11 polypeptide of SEQ ID NO: 73. In an embodiment, the composition of the invention comprises the GH62 polypeptide of SEQ ID NO: 9 and the GH11 polypeptide of SEQ ID NO: 74. In an embodiment, the composition of the invention comprises the GH62 polypeptide of SEQ ID NO: 9 and the GH11 polypeptide of SEQ ID NO: 75. In an embodiment, the composition of the invention comprises the GH62 polypeptide of SEQ ID NO: 9 and the GH11 polypeptide of SEQ ID NO: 78. In an embodiment, the composition of the invention comprises the GH62 polypeptide of SEQ ID NO: 9 and the GH11 polypeptide of SEQ ID NO: 81. In an embodiment, the composition of the invention comprises the GH62 polypeptide of SEQ ID NO: 9 and the GH11 polypeptide of SEQ ID NO: 84. In an embodiment, the composition of the invention comprises the GH62 polypeptide of SEQ ID NO: 9 and the GH11 polypeptide of SEQ ID NO: 87. In an embodiment, the composition of the invention comprises the GH62 polypeptide of SEQ ID NO: 9 and the GH11 polypeptide of SEQ ID NO: 88. In an embodiment, the composition of the invention comprises the GH62 polypeptide of SEQ ID NO: 9 and the GH11 polypeptide of SEQ ID NO: 89. In an embodiment, the composition of the invention comprises the GH62 polypeptide of SEQ ID NO: 9 and the GH10 polypeptide of SEQ ID NO: 95. In an embodiment, the composition of the invention comprises the GH62 polypeptide of SEQ ID NO: 9 and the GH11 polypeptide of SEQ ID NO: 96. In an embodiment, the composition of the invention comprises the GH62 polypeptide of SEQ ID NO: 9 and the GH11 polypeptide of SEQ ID NO: 99. In an embodiment, the composition of the invention comprises the GH62 polypeptide of SEQ ID NO: 9 and the GH10 polypeptide of SEQ ID NO: 102. In an embodiment, the composition of the invention comprises the GH62 polypeptide of SEQ ID NO: 9 and the GH10 polypeptide of SEQ ID NO: 180.

In an embodiment, the composition of the invention comprises the GH62 polypeptide of SEQ ID NO: 12 and the GH10 polypeptide of SEQ ID NO: 70. In an embodiment, the composition of the invention comprises the GH62 polypeptide of SEQ ID NO: 12 and the GH10 polypeptide of SEQ ID NO: 71. In an embodiment, the composition of the invention comprises the GH62 polypeptide of SEQ ID NO: 12 and the GH10 polypeptide of SEQ ID NO: 72. In an embodiment, the composition of the invention comprises the GH62 polypeptide of SEQ ID NO: 12 and the GH11 polypeptide of SEQ ID NO: 73. In an embodiment, the composition of the invention comprises the GH62 polypeptide of SEQ ID NO: 12 and the GH11 polypeptide of SEQ ID NO: 74. In an embodiment, the composition of the invention comprises the GH62 polypeptide of SEQ ID NO: 12 and the GH11 polypeptide of SEQ ID NO: 75. In an embodiment, the composition of the invention comprises the GH62 polypeptide of SEQ ID NO: 12 and the GH11 polypeptide of SEQ ID NO: 78. In an embodiment, the composition of the invention comprises the GH62 polypeptide of SEQ ID NO: 12 and the GH11 polypeptide of SEQ ID NO: 81. In an embodiment, the composition of the invention comprises the GH62 polypeptide of SEQ ID NO: 12 and the GH11 polypeptide of SEQ ID NO: 84. In an embodiment, the composition of the invention comprises the GH62 polypeptide of SEQ ID NO: 12 and the GH11 polypeptide of SEQ ID NO: 87. In an embodiment, the composition of the invention comprises the GH62 polypeptide of SEQ ID NO: 12 and the GH11 polypeptide of SEQ ID NO: 88. In an embodiment, the composition of the invention comprises the GH62 polypeptide of SEQ ID NO: 12 and the GH11 polypeptide of SEQ ID NO: 89. In an embodiment, the composition of the invention comprises the GH62 polypeptide of SEQ ID NO: 12 and the GH10 polypeptide of SEQ ID NO: 95. In an embodiment, the composition of the invention comprises the GH62 polypeptide of SEQ ID NO: 12 and the GH11 polypeptide of SEQ ID NO: 96. In an embodiment, the composition of the invention comprises the GH62 polypeptide of SEQ ID NO:

12 and the GH11 polypeptide of SEQ ID NO: 99. In an embodiment, the composition of the invention comprises the GH62 polypeptide of SEQ ID NO: 12 and the GH10 polypeptide of SEQ ID NO: 102. In an embodiment, the composition of the invention comprises the GH62 polypeptide of SEQ ID NO: 12 and the GH10 polypeptide of SEQ ID NO: 180.

In an embodiment, the composition of the invention comprises the GH62 polypeptide of SEQ ID NO: 15 and the GH10 polypeptide of SEQ ID NO: 70. In an embodiment, the composition of the invention comprises the GH62 polypeptide of SEQ ID NO: 15 and the GH10 polypeptide of SEQ ID NO: 71. In an embodiment, the composition of the invention comprises the GH62 polypeptide of SEQ ID NO: 15 and the GH10 polypeptide of SEQ ID NO: 72. In an embodiment, the composition of the invention comprises the GH62 polypeptide of SEQ ID NO: 15 and the GH11 polypeptide of SEQ ID NO: 73. In an embodiment, the composition of the invention comprises the GH62 polypeptide of SEQ ID NO: 15 and the GH11 polypeptide of SEQ ID NO: 74. In an embodiment, the composition of the invention comprises the GH62 polypeptide of SEQ ID NO: 15 and the GH11 polypeptide of SEQ ID NO: 75. In an embodiment, the composition of the invention comprises the GH62 polypeptide of SEQ ID NO: 15 and the GH11 polypeptide of SEQ ID NO: 78. In an embodiment, the composition of the invention comprises the GH62 polypeptide of SEQ ID NO: 15 and the GH11 polypeptide of SEQ ID NO: 81. In an embodiment, the composition of the invention comprises the GH62 polypeptide of SEQ ID NO: 15 and the GH11 polypeptide of SEQ ID NO: 84. In an embodiment, the composition of the invention comprises the GH62 polypeptide of SEQ ID NO: 15 and the GH11 polypeptide of SEQ ID NO: 87. In an embodiment, the composition of the invention comprises the GH62 polypeptide of SEQ ID NO: 15 and the GH11 polypeptide of SEQ ID NO: 88. In an embodiment, the composition of the invention comprises the GH62 polypeptide of SEQ ID NO: 15 and the GH11 polypeptide of SEQ ID NO: 89. In an embodiment, the composition of the invention comprises the GH62 polypeptide of SEQ ID NO: 15 and the GH10 polypeptide of SEQ ID NO: 95. In an embodiment, the composition of the invention comprises the GH62 polypeptide of SEQ ID NO: 15 and the GH11 polypeptide of SEQ ID NO: 96. In an embodiment, the composition of the invention comprises the GH62 polypeptide of SEQ ID NO: 15 and the GH11 polypeptide of SEQ ID NO: 99. In an embodiment, the composition of the invention comprises the GH62 polypeptide of SEQ ID NO: 15 and the GH10 polypeptide of SEQ ID NO: 102. In an embodiment, the composition of the invention comprises the GH62 polypeptide of SEQ ID NO: 15 and the GH10 polypeptide of SEQ ID NO: 180.

In an embodiment, the composition of the invention comprises the GH62 polypeptide of SEQ ID NO: 18 and the GH10 polypeptide of SEQ ID NO: 70. In an embodiment, the composition of the invention comprises the GH62 polypeptide of SEQ ID NO: 18 and the GH10 polypeptide of SEQ ID NO: 71. In an embodiment, the composition of the invention comprises the GH62 polypeptide of SEQ ID NO: 18 and the GH10 polypeptide of SEQ ID NO: 72. In an embodiment, the composition of the invention comprises the GH62 polypeptide of SEQ ID NO: 18 and the GH11 polypeptide of SEQ ID NO: 73. In an embodiment, the composition of the invention comprises the GH62 polypeptide of SEQ ID NO: 18 and the GH11 polypeptide of SEQ ID NO: 74. In an embodiment, the composition of the invention comprises the GH62 polypeptide of SEQ ID NO: 18 and the GH11 polypeptide of SEQ ID NO: 75. In an embodiment, the composition of the invention comprises the GH62 polypeptide of SEQ ID NO: 18 and the GH11 polypeptide of SEQ ID NO: 78. In an embodiment, the composition of the invention comprises the GH62 polypeptide of SEQ ID NO: 18 and the GH11 polypeptide of SEQ ID NO: 81. In an embodiment, the composition of the invention comprises the GH62 polypeptide of SEQ ID NO: 18 and the GH11 polypeptide of SEQ ID NO: 84. In an embodiment, the composition of the invention comprises the GH62 polypeptide of SEQ ID NO: 18 and the GH11 polypeptide of SEQ ID NO: 87. In an embodiment, the composition of the invention comprises the GH62 polypeptide of SEQ ID NO: 18 and the GH11 polypeptide of SEQ ID NO: 88. In an embodiment, the composition of the invention comprises the GH62 polypeptide of SEQ ID NO: 18 and the GH11 polypeptide of SEQ ID NO: 89. In an embodiment, the composition of the invention comprises the GH62 polypeptide of SEQ ID NO: 18 and the GH10 polypeptide of SEQ ID NO: 95. In an embodiment, the composition of the invention comprises the GH62 polypeptide of SEQ ID NO: 18 and the GH11 polypeptide of SEQ ID NO: 96. In an embodiment, the composition of the invention comprises the GH62 polypeptide of SEQ ID NO: 18 and the GH11 polypeptide of SEQ ID NO: 99. In an embodiment, the composition of the invention comprises the GH62 polypeptide of SEQ ID NO: 18 and the GH10 polypeptide of SEQ ID NO: 102. In an embodiment, the composition of the invention comprises the GH62 polypeptide of SEQ ID NO: 18 and the GH10 polypeptide of SEQ ID NO: 180.

In an embodiment, the composition of the invention comprises the GH62 polypeptide of SEQ ID NO: 21 and the GH10 polypeptide of SEQ ID NO: 70. In an embodiment, the composition of the invention comprises the GH62 polypeptide of SEQ ID NO: 21 and the GH10 polypeptide of SEQ ID NO: 71. In an embodiment, the composition of the invention comprises the GH62 polypeptide of SEQ ID NO: 21 and the GH10 polypeptide of SEQ ID NO: 72. In an embodiment, the composition of the invention comprises the GH62 polypeptide of SEQ ID NO: 21 and the GH11 polypeptide of SEQ ID NO: 73. In an embodiment, the composition of the invention comprises the GH62 polypeptide of SEQ ID NO: 21 and the GH11 polypeptide of SEQ ID NO: 74. In an embodiment, the composition of the invention comprises the GH62 polypeptide of SEQ ID NO: 21 and the GH11 polypeptide of SEQ ID NO: 75. In an embodiment, the composition of the invention comprises the GH62 polypeptide of SEQ ID NO: 21 and the GH11 polypeptide of SEQ ID NO: 78. In an embodiment, the composition of the invention comprises the GH62 polypeptide of SEQ ID NO: 21 and the GH11 polypeptide of SEQ ID NO: 81. In an embodiment, the composition of the invention comprises the GH62 polypeptide of SEQ ID NO: 21 and the GH11 polypeptide of SEQ ID NO: 84. In an embodiment, the composition of the invention comprises the GH62 polypeptide of SEQ ID NO: 21 and the GH11 polypeptide of SEQ ID NO: 87. In an embodiment, the composition of the invention comprises the GH62 polypeptide of SEQ ID NO: 21 and the GH11 polypeptide of SEQ ID NO: 88. In an embodiment, the composition of the invention comprises the GH62 polypeptide of SEQ ID NO: 21 and the GH11 polypeptide of SEQ ID NO: 89. In an embodiment, the composition of the invention comprises the GH62 polypeptide of SEQ ID NO: 21 and the GH10 polypeptide of SEQ ID NO: 95. In an embodiment, the composition of the invention comprises the GH62 polypeptide of SEQ ID NO: 21 and the GH11 polypeptide of SEQ ID NO: 96. In an embodiment, the composition of the invention comprises the GH62 polypeptide of SEQ ID NO: 21 and the GH11 polypeptide of SEQ ID NO: 99. In an embodiment, the composition of the invention comprises the GH62 polypeptide of SEQ ID NO: 21 and the GH10 polypeptide of SEQ ID NO: 102. In an embodiment, the composition of the invention comprises the GH62 polypeptide of SEQ ID NO: 21 and the GH10 polypeptide of SEQ ID NO: 180.

In an embodiment, the composition of the invention comprises the GH62 polypeptide of SEQ ID NO: 24 and the GH10 polypeptide of SEQ ID NO: 70. In an embodiment, the composition of the invention comprises the GH62 polypeptide of SEQ ID NO: 24 and the GH10 polypeptide of SEQ ID NO: 71. In an embodiment, the composition of the invention comprises the GH62 polypeptide of SEQ ID NO: 24 and the GH10 polypeptide of SEQ ID NO: 72. In an embodiment, the composition of the invention comprises the GH62 polypeptide of SEQ ID NO: 24 and the GH11 polypeptide of SEQ ID NO: 73. In an embodiment, the composition of the invention comprises the GH62 polypeptide of SEQ ID NO: 24 and the GH11 polypeptide of SEQ ID NO: 74. In an embodiment, the composition of the invention comprises the GH62 polypeptide of SEQ ID NO: 24 and the GH11 polypeptide of SEQ ID NO: 75. In an embodiment, the composition of the invention comprises the GH62 polypeptide of SEQ ID NO: 24 and the GH11 polypeptide of SEQ ID NO: 78. In an embodiment, the composition of the invention comprises the GH62 polypeptide of SEQ ID NO: 24 and the GH11 polypeptide of SEQ ID NO: 81. In an embodiment, the composition of the invention comprises the GH62 polypeptide of SEQ ID NO: 24 and the GH11 polypeptide of SEQ ID NO: 84. In an embodiment, the composition of the invention comprises the GH62 polypeptide of SEQ ID NO: 24 and the GH11 polypeptide of SEQ ID NO: 87. In an embodiment, the composition of the invention comprises the GH62 polypeptide of SEQ ID NO: 24 and the GH11 polypeptide of SEQ ID NO: 88. In an embodiment, the composition of the invention comprises the GH62 polypeptide of SEQ ID NO: 24 and the GH11 polypeptide of SEQ ID NO: 89. In an embodiment, the composition of the invention comprises the GH62 polypeptide of SEQ ID NO: 24 and the GH10 polypeptide of SEQ ID NO: 95. In an embodiment, the composition of the invention comprises the GH62 polypeptide of SEQ ID NO: 24 and the GH11 polypeptide of SEQ ID NO: 96. In an embodiment, the composition of the invention comprises the GH62 polypeptide of SEQ ID NO: 24 and the GH11 polypeptide of SEQ ID NO: 99. In an embodiment, the composition of the invention comprises the GH62 polypeptide of SEQ ID NO: 24 and the GH10 polypeptide of SEQ ID NO: 102. In an embodiment, the composition of the invention comprises the GH62 polypeptide of SEQ ID NO: 24 and the GH10 polypeptide of SEQ ID NO: 180.

In an embodiment, the composition of the invention comprises the GH62 polypeptide of SEQ ID NO: 27 and the GH10 polypeptide of SEQ ID NO: 70. In an embodiment, the composition of the invention comprises the GH62 polypeptide of SEQ ID NO: 27 and the GH10 polypeptide of SEQ ID NO: 71. In an embodiment, the composition of the invention comprises the GH62 polypeptide of SEQ ID NO: 27 and the GH10 polypeptide of SEQ ID NO: 72. In an embodiment, the composition of the invention comprises the GH62 polypeptide of SEQ ID NO: 27 and the GH11 polypeptide of SEQ ID NO: 73. In an embodiment, the composition of the invention comprises the GH62 polypeptide of SEQ ID NO: 27 and the GH11 polypeptide of SEQ ID NO: 74. In an embodiment, the composition of the invention comprises the GH62 polypeptide of SEQ ID NO: 27 and the GH11 polypeptide of SEQ ID NO: 75. In an embodiment, the composition of the invention comprises the GH62 polypeptide of SEQ ID NO: 27 and the GH11 polypeptide of SEQ ID NO: 78. In an embodiment, the composition of the invention comprises the GH62 polypeptide of SEQ ID NO: 27 and the GH11 polypeptide of SEQ ID NO: 81. In an embodiment, the composition of the invention comprises the GH62 polypeptide of SEQ ID NO: 27 and the GH11 polypeptide of SEQ ID NO: 84. In an embodiment, the composition of the invention comprises the GH62 polypeptide of SEQ ID NO: 27 and the GH11 polypeptide of SEQ ID NO: 87. In an embodiment, the composition of the invention comprises the GH62 polypeptide of SEQ ID NO: 27 and the GH11 polypeptide of SEQ ID NO: 88. In an embodiment, the composition of the invention comprises the GH62 polypeptide of SEQ ID NO: 27 and the GH11 polypeptide of SEQ ID NO: 89. In an embodiment, the composition of the invention comprises the GH62 polypeptide of SEQ ID NO: 27 and the GH10 polypeptide of SEQ ID NO: 95. In an embodiment, the composition of the invention comprises the GH62 polypeptide of SEQ ID NO: 27 and the GH11 polypeptide of SEQ ID NO: 96. In an embodiment, the composition of the invention comprises the GH62 polypeptide of SEQ ID NO: 27 and the GH11 polypeptide of SEQ ID NO: 99. In an embodiment, the composition of the invention comprises the GH62 polypeptide of SEQ ID NO: 27 and the GH10 polypeptide of SEQ ID NO: 102. In an embodiment, the composition of the invention comprises the GH62 polypeptide of SEQ ID NO: 27 and the GH10 polypeptide of SEQ ID NO: 180.

In an embodiment, the composition of the invention comprises the GH62 polypeptide of SEQ ID NO: 30 and the GH10 polypeptide of SEQ ID NO: 70. In an embodiment, the composition of the invention comprises the GH62 polypeptide of SEQ ID NO: 30 and the GH10 polypeptide of SEQ ID NO: 71. In an embodiment, the composition of the invention comprises the GH62 polypeptide of SEQ ID NO: 30 and the GH10 polypeptide of SEQ ID NO: 72. In an embodiment, the composition of the invention comprises the GH62 polypeptide of SEQ ID NO: 30 and the GH11 polypeptide of SEQ ID NO: 73. In an embodiment, the composition of the invention comprises the GH62 polypeptide of SEQ ID NO: 30 and the GH11 polypeptide of SEQ ID NO: 74. In an embodiment, the composition of the invention comprises the GH62 polypeptide of SEQ ID NO: 30 and the GH11 polypeptide of SEQ ID NO: 75. In an embodiment, the composition of the invention comprises the GH62 polypeptide of SEQ ID NO: 30 and the GH11 polypeptide of SEQ ID NO: 78. In an embodiment, the composition of the invention comprises the GH62 polypeptide of SEQ ID NO: 30 and the GH11 polypeptide of SEQ ID NO: 81. In an embodiment, the composition of the invention comprises the GH62 polypeptide of SEQ ID NO: 30 and the GH11 polypeptide of SEQ ID NO: 84. In an embodiment, the composition of the invention comprises the GH62 polypeptide of SEQ ID NO: 30 and the GH11 polypeptide of SEQ ID NO: 87. In an embodiment, the composition of the invention comprises the GH62 polypeptide of SEQ ID NO: 30 and the GH11 polypeptide of SEQ ID NO: 88. In an embodiment, the composition of the invention comprises the GH62 polypeptide of SEQ ID NO:

30 and the GH11 polypeptide of SEQ ID NO: 89. In an embodiment, the composition of the invention comprises the GH62 polypeptide of SEQ ID NO: 30 and the GH10 polypeptide of SEQ ID NO: 95. In an embodiment, the composition of the invention comprises the GH62 polypeptide of SEQ ID NO: 30 and the GH11 polypeptide of SEQ ID NO: 96. In an embodiment, the composition of the invention comprises the GH62 polypeptide of SEQ ID NO: 30 and the GH11 polypeptide of SEQ ID NO: 99. In an embodiment, the composition of the invention comprises the GH62 polypeptide of SEQ ID NO: 30 and the GH10 polypeptide of SEQ ID NO: 102. In an embodiment, the composition of the invention comprises the GH62 polypeptide of SEQ ID NO: 30 and the GH10 polypeptide of SEQ ID NO: 180.

In an embodiment, the composition of the invention comprises the GH62 polypeptide of SEQ ID NO: 36 and the GH10 polypeptide of SEQ ID NO: 70. In an embodiment, the composition of the invention comprises the GH62 polypeptide of SEQ ID NO: 36 and the GH10 polypeptide of SEQ ID NO: 71. In an embodiment, the composition of the invention comprises the GH62 polypeptide of SEQ ID NO: 36 and the GH10 polypeptide of SEQ ID NO: 72. In an embodiment, the composition of the invention comprises the GH62 polypeptide of SEQ ID NO: 36 and the GH11 polypeptide of SEQ ID NO: 73. In an embodiment, the composition of the invention comprises the GH62 polypeptide of SEQ ID NO: 36 and the GH11 polypeptide of SEQ ID NO: 74. In an embodiment, the composition of the invention comprises the GH62 polypeptide of SEQ ID NO: 36 and the GH11 polypeptide of SEQ ID NO: 75. In an embodiment, the composition of the invention comprises the GH62 polypeptide of SEQ ID NO: 36 and the GH11 polypeptide of SEQ ID NO: 78. In an embodiment, the composition of the invention comprises the GH62 polypeptide of SEQ ID NO: 9 and the GH11 polypeptide of SEQ ID NO: 81. In an embodiment, the composition of the invention comprises the GH62 polypeptide of SEQ ID NO: 36 and the GH11 polypeptide of SEQ ID NO: 84. In an embodiment, the composition of the invention comprises the GH62 polypeptide of SEQ ID NO: 36 and the GH11 polypeptide of SEQ ID NO: 87. In an embodiment, the composition of the invention comprises the GH62 polypeptide of SEQ ID NO: 36 and the GH11 polypeptide of SEQ ID NO: 88. In an embodiment, the composition of the invention comprises the GH62 polypeptide of SEQ ID NO: 36 and the GH11 polypeptide of SEQ ID NO: 89. In an embodiment, the composition of the invention comprises the GH62 polypeptide of SEQ ID NO: 36 and the GH10 polypeptide of SEQ ID NO: 95. In an embodiment, the composition of the invention comprises the GH62 polypeptide of SEQ ID NO: 36 and the GH11 polypeptide of SEQ ID NO: 96. In an embodiment, the composition of the invention comprises the GH62 polypeptide of SEQ ID NO: 36 and the GH11 polypeptide of SEQ ID NO: 99. In an embodiment, the composition of the invention comprises the GH62 polypeptide of SEQ ID NO: 36 and the GH10 polypeptide of SEQ ID NO: 102. In an embodiment, the composition of the invention comprises the GH62 polypeptide of SEQ ID NO: 36 and the GH10 polypeptide of SEQ ID NO: 180.

In an embodiment, the composition of the invention comprises the GH62 polypeptide of SEQ ID NO: 42 and the GH10 polypeptide of SEQ ID NO: 70. In an embodiment, the composition of the invention comprises the GH62 polypeptide of SEQ ID NO: 42 and the GH10 polypeptide of SEQ ID NO: 71. In an embodiment, the composition of the invention comprises the GH62 polypeptide of SEQ ID NO: 42 and the GH10 polypeptide of SEQ ID NO: 72. In an embodiment, the composition of the invention comprises the GH62 polypeptide of SEQ ID NO: 42 and the GH11 polypeptide of SEQ ID NO: 73. In an embodiment, the composition of the invention comprises the GH62 polypeptide of SEQ ID NO: 42 and the GH11 polypeptide of SEQ ID NO: 74. In an embodiment, the composition of the invention comprises the GH62 polypeptide of SEQ ID NO: 42 and the GH11 polypeptide of SEQ ID NO: 75. In an embodiment, the composition of the invention comprises the GH62 polypeptide of SEQ ID NO: 42 and the GH11 polypeptide of SEQ ID NO: 78. In an embodiment, the composition of the invention comprises the GH62 polypeptide of SEQ ID NO: 42 and the GH11 polypeptide of SEQ ID NO: 81. In an embodiment, the composition of the invention comprises the GH62 polypeptide of SEQ ID NO: 42 and the GH11 polypeptide of SEQ ID NO: 84. In an embodiment, the composition of the invention comprises the GH62 polypeptide of SEQ ID NO: 42 and the GH11 polypeptide of SEQ ID NO: 87. In an embodiment, the composition of the invention comprises the GH62 polypeptide of SEQ ID NO: 42 and the GH11 polypeptide of SEQ ID NO: 88. In an embodiment, the composition of the invention comprises the GH62 polypeptide of SEQ ID NO: 42 and the GH11 polypeptide of SEQ ID NO: 89. In an embodiment, the composition of the invention comprises the GH62 polypeptide of SEQ ID NO: 42 and the GH10 polypeptide of SEQ ID NO: 95. In an embodiment, the composition of the invention comprises the GH62 polypeptide of SEQ ID NO: 42 and the GH11 polypeptide of SEQ ID NO: 96. In an embodiment, the composition of the invention comprises the GH62 polypeptide of SEQ ID NO: 42 and the GH11 polypeptide of SEQ ID NO: 99. In an embodiment, the composition of the invention comprises the GH62 polypeptide of SEQ ID NO: 42 and the GH10 polypeptide of SEQ ID NO: 102. In an embodiment, the composition of the invention comprises the GH62 polypeptide of SEQ ID NO: 42 and the GH10 polypeptide of SEQ ID NO: 180.

In an embodiment, the composition of the invention comprises the GH62 polypeptide of SEQ ID NO: 48 and the GH10 polypeptide of SEQ ID NO: 70. In an embodiment, the composition of the invention comprises the GH62 polypeptide of SEQ ID NO: 48 and the GH10 polypeptide of SEQ ID NO: 71. In an embodiment, the composition of the invention comprises the GH62 polypeptide of SEQ ID NO: 48 and the GH10 polypeptide of SEQ ID NO: 72. In an embodiment, the composition of the invention comprises the GH62 polypeptide of SEQ ID NO: 48 and the GH11 polypeptide of SEQ ID NO: 73. In an embodiment, the composition of the invention comprises the GH62 polypeptide of SEQ ID NO: 48 and the GH11 polypeptide of SEQ ID NO: 74. In an embodiment, the composition of the invention comprises the GH62 polypeptide of SEQ ID NO: 48 and the GH11 polypeptide of SEQ ID NO: 75. In an embodiment, the composition of the invention comprises the GH62 polypeptide of SEQ ID NO: 48 and the GH11 polypeptide of SEQ ID NO: 78. In an embodiment, the composition of the invention comprises the GH62 polypeptide of SEQ ID NO: 48 and the GH11 polypeptide of SEQ ID NO: 81. In an embodiment, the composition of the invention comprises the GH62 polypeptide of SEQ ID NO: 48 and the GH11 polypeptide of SEQ ID NO: 84. In an embodiment, the composition of the invention comprises the GH62 polypeptide of SEQ ID NO: 48 and the GH11 polypeptide of SEQ ID NO: 87. In an embodiment, the composition of the invention does not comprise the GH62 polypeptide of SEQ ID NO: 48 and the GH11 polypeptide of SEQ ID NO: 88. In an embodiment, the composition of the invention comprises the GH62 polypeptide of SEQ ID NO: 48 and the GH11 polypeptide of SEQ ID NO: 89. In an embodiment, the composition of the invention comprises the GH62 polypeptide of SEQ ID NO: 48 and the GH10 polypeptide of SEQ ID NO: 95. In an embodiment, the composition of the invention comprises the GH62 polypeptide of SEQ ID NO: 48 and the GH11 polypeptide of SEQ ID NO: 96. In an embodiment, the composition of the invention comprises the GH62 polypeptide of SEQ ID NO: 48 and the GH11 polypeptide of SEQ ID NO: 99. In an embodiment, the composition of the invention comprises the GH62 polypeptide of SEQ ID NO: 48 and the GH10 polypeptide of SEQ ID NO: 102. In an embodiment, the composition of the invention comprises the GH62 polypeptide of SEQ ID NO: 48 and the GH10 polypeptide of SEQ ID NO: 180.

In an embodiment, the composition of the invention comprises the GH62 polypeptide of SEQ ID NO: 54 and the GH10 polypeptide of SEQ ID NO: 70. In an embodiment, the composition of the invention comprises the GH62 polypeptide of SEQ ID NO: 54 and the GH10 polypeptide of SEQ ID NO: 71. In an embodiment, the composition of the invention comprises the GH62 polypeptide of SEQ ID NO: 54 and the GH10 polypeptide of SEQ ID NO: 72. In an embodiment, the composition of the invention comprises the GH62 polypeptide of SEQ ID NO: 54 and the GH11 polypeptide of SEQ ID NO: 73. In an embodiment, the composition of the invention comprises the GH62 polypeptide of SEQ ID NO: 54 and the GH11 polypeptide of SEQ ID NO: 74. In an embodiment, the composition of the invention comprises the GH62 polypeptide of SEQ ID NO: 54 and the GH11 polypeptide of SEQ ID NO: 75. In an embodiment, the composition of the invention comprises the GH62 polypeptide of SEQ ID NO: 54 and the GH11 polypeptide of SEQ ID NO: 78. In an embodiment, the composition of the invention comprises the GH62 polypeptide of SEQ ID NO: 54 and the GH11 polypeptide of SEQ ID NO: 81. In an embodiment, the composition of the invention comprises the GH62 polypeptide of SEQ ID NO: 54 and the GH11 polypeptide of SEQ ID NO: 84. In an embodiment, the composition of the invention comprises the GH62 polypeptide of SEQ ID NO: 54 and the GH11 polypeptide of SEQ ID NO: 87. In an embodiment, the composition of the invention comprises the GH62 polypeptide of SEQ ID NO: 54 and the GH11 polypeptide of SEQ ID NO: 88. In an embodiment, the composition of the invention comprises the GH62 polypeptide of SEQ ID NO: 54 and the GH11 polypeptide of SEQ ID NO: 89. In an embodiment, the composition of the invention comprises the GH62 polypeptide of SEQ ID NO: 54 and the GH10 polypeptide of SEQ ID NO: 95. In an embodiment, the composition of the invention comprises the GH62 polypeptide of SEQ ID NO: 54 and the GH11 polypeptide of SEQ ID NO: 96. In an embodiment, the composition of the invention comprises the GH62 polypeptide of SEQ ID NO: 54 and the GH11 polypeptide of SEQ ID NO: 99. In an embodiment, the composition of the invention comprises the GH62 polypeptide of SEQ ID NO: 54 and the GH10 polypeptide of SEQ ID NO: 102. In an embodiment, the composition of the invention comprises the GH62 polypeptide of SEQ ID NO: 54 and the GH10 polypeptide of SEQ ID NO: 180.

In an embodiment, the composition of the invention comprises the GH62 polypeptide of SEQ ID NO: 60 and the GH10 polypeptide of SEQ ID NO: 70. In an embodiment, the composition of the invention comprises the GH62 polypeptide of SEQ ID NO: 60 and the GH10 polypeptide of SEQ ID NO: 71. In an embodiment, the composition of the invention comprises the GH62 polypeptide of SEQ ID NO: 60 and the GH10 polypeptide of SEQ ID NO: 72. In an embodiment, the composition of the invention comprises the GH62 polypeptide of SEQ ID NO: 60 and the GH11 polypeptide of SEQ ID NO: 73. In an embodiment, the composition of the invention comprises the GH62 polypeptide of SEQ ID NO: 60 and the GH11 polypeptide of SEQ ID NO: 74. In an embodiment, the composition of the invention comprises the GH62 polypeptide of SEQ ID NO: 60 and the GH11 polypeptide of SEQ ID NO: 75. In an embodiment, the composition of the invention comprises the GH62 polypeptide of SEQ ID NO: 60 and the GH11 polypeptide of SEQ ID NO: 78. In an embodiment, the composition of the invention comprises the GH62 polypeptide of SEQ ID NO: 60 and the GH11 polypeptide of SEQ ID NO: 81. In an embodiment, the composition of the invention comprises the GH62 polypeptide of SEQ ID NO: 60 and the GH11 polypeptide of SEQ ID NO: 84. In an embodiment, the composition of the invention comprises the GH62 polypeptide of SEQ ID NO: 60 and the GH11 polypeptide of SEQ ID NO: 87. In an embodiment, the composition of the invention comprises the GH62 polypeptide of SEQ ID NO: 60 and the GH11 polypeptide of SEQ ID NO: 88. In an embodiment, the composition of the invention comprises the GH62 polypeptide of SEQ ID NO: 60 and the GH11 polypeptide of SEQ ID NO: 89. In an embodiment, the composition of the invention comprises the GH62 polypeptide of SEQ ID NO: 60 and the GH10 polypeptide of SEQ ID NO: 95. In an embodiment, the composition of the invention comprises the GH62 polypeptide of SEQ ID NO: 60 and the GH11 polypeptide of SEQ ID NO: 96. In an embodiment, the composition of the invention comprises the GH62 polypeptide of SEQ ID NO: 60 and the GH11 polypeptide of SEQ ID NO: 99. In an embodiment, the composition of the invention comprises the GH62 polypeptide of SEQ ID NO: 60 and the GH10 polypeptide of SEQ ID NO: 102. In an embodiment, the composition of the invention comprises the GH62 polypeptide of SEQ ID NO: 60 and the GH10 polypeptide of SEQ ID NO: 180.

In an embodiment, the composition of the invention comprises the GH62 polypeptide of SEQ ID NO: 66 and the GH10 polypeptide of SEQ ID NO: 70. In an embodiment, the composition of the invention comprises the GH62 polypeptide of SEQ ID NO: 66 and the GH10 polypeptide of SEQ ID NO: 71. In an embodiment, the composition of the invention comprises the GH62 polypeptide of SEQ ID NO: 66 and the GH10 polypeptide of SEQ ID NO: 72. In an embodiment, the composition of the invention comprises the GH62 polypeptide of SEQ ID NO: 66 and the GH11 polypeptide of SEQ ID NO: 73. In an embodiment, the composition of the invention comprises the GH62 polypeptide of SEQ ID NO: 66 and the GH11 polypeptide of SEQ ID NO: 74. In an embodiment, the composition of the invention comprises the GH62 polypeptide of SEQ ID NO: 66 and the GH11 polypeptide of SEQ ID NO: 75. In an embodiment, the composition of the invention comprises the GH62 polypeptide of SEQ ID NO: 66 and the GH11 polypeptide of SEQ ID NO: 78. In an embodiment, the composition of the invention comprises the GH62 polypeptide of SEQ ID NO: 66 and the GH11 polypeptide of SEQ ID NO: 81. In an embodiment, the composition of the invention comprises the GH62 polypeptide of SEQ ID NO: 66 and the GH11 polypeptide of SEQ ID NO: 84. In an embodiment, the composition of the invention comprises the GH62 polypeptide of SEQ ID NO: 66 and the GH11 polypeptide of SEQ ID NO: 87. In an embodiment, the composition of the invention comprises the GH62 polypeptide of SEQ ID NO: 66 and the GH11 polypeptide of SEQ ID NO: 88. In an embodiment, the composition of the invention comprises the GH62 polypeptide of SEQ ID NO: 66 and the GH11 polypeptide of SEQ ID NO: 89. In an embodiment, the composition of the invention comprises the GH62 polypeptide of SEQ ID NO: 66 and the GH10 polypeptide of SEQ ID NO: 95. In an embodiment, the composition of the invention comprises the GH62 polypeptide of SEQ ID NO: 66 and the GH11 polypeptide of SEQ ID NO: 96. In an embodiment, the composition of the invention comprises the GH62 polypeptide of SEQ ID NO: 66 and the GH11 polypeptide of SEQ ID NO: 99. In an embodiment, the composition of the invention comprises the GH62 polypeptide of SEQ ID NO: 66 and the GH10 polypeptide of SEQ ID NO: 102. In an embodiment, the composition of the invention comprises the GH62 polypeptide of SEQ ID NO: 66 and the GH10 polypeptide of SEQ ID NO: 180.

In an embodiment, the composition of the invention comprises the GH62 polypeptide of SEQ ID NO: 105 and the GH10 polypeptide of SEQ ID NO: 70. In an embodiment, the composition of the invention comprises the GH62 polypeptide of SEQ ID NO: 105 and the GH10 polypeptide of SEQ ID NO: 71. In an embodiment, the composition of the invention comprises the GH62 polypeptide of SEQ ID NO: 105 and the GH10 polypeptide of SEQ ID NO: 72. In an embodiment, the composition of the invention comprises the GH62 polypeptide of SEQ ID NO: 105 and the GH11 polypeptide of SEQ ID NO: 73. In an embodiment, the composition of the invention comprises the GH62 polypeptide of SEQ ID NO: 105 and the GH11 polypeptide of SEQ ID NO: 74. In an embodiment, the composition of the invention comprises the GH62 polypeptide of SEQ ID NO: 105 and the GH11 polypeptide of SEQ ID NO: 75. In an embodiment, the composition of the invention comprises the GH62 polypeptide of SEQ ID NO: 105 and the GH11 polypeptide of SEQ ID NO: 78. In an embodiment, the composition of the invention comprises the GH62 polypeptide of SEQ ID NO: 105 and the GH11 polypeptide of SEQ ID NO: 81. In an embodiment, the composition of the invention comprises the GH62 polypeptide of SEQ ID NO: 105 and the GH11 polypeptide of SEQ ID NO: 84. In an embodiment, the composition of the invention comprises the GH62 polypeptide of SEQ ID NO: 105 and the GH11 polypeptide of SEQ ID NO: 87. In an embodiment, the composition of the invention comprises the GH62 polypeptide of SEQ ID NO: 105 and the GH11 polypeptide of SEQ ID NO: 88. In an embodiment, the composition of the invention comprises the GH62 polypeptide of SEQ ID NO: 105 and the GH11 polypeptide of SEQ ID NO: 89. In an embodiment, the composition of the invention comprises the GH62 polypeptide of SEQ ID NO: 105 and the GH10 polypeptide of SEQ ID NO: 95. In an embodiment, the composition of the invention comprises the GH62 polypeptide of SEQ ID NO: 105 and the GH11 polypeptide of SEQ ID NO: 96. In an embodiment, the composition of the invention comprises the GH62 polypeptide of SEQ ID NO: 105 and the GH11 polypeptide of SEQ ID NO: 99. In an embodiment, the composition of the invention comprises the GH62 polypeptide of SEQ ID NO: 105 and the GH10 polypeptide of SEQ ID NO: 102. In an embodiment, the composition of the invention comprises the GH62 polypeptide of SEQ ID NO: 105 and the GH10 polypeptide of SEQ ID NO: 180.

In an embodiment, the composition of the invention comprises the GH62 polypeptide of SEQ ID NO: 108 and the GH10 polypeptide of SEQ ID NO: 70. In an embodiment, the composition of the invention comprises the GH62 polypeptide of SEQ ID NO: 108 and the GH10 polypeptide of SEQ ID NO: 71. In an embodiment, the composition of the invention comprises the GH62 polypeptide of SEQ ID NO: 108 and the GH10 polypeptide of SEQ ID NO: 72. In an embodiment, the composition of the invention comprises the GH62 polypeptide of SEQ ID NO: 108 and the GH11 polypeptide of SEQ ID NO: 73. In an embodiment, the composition of the invention comprises the GH62 polypeptide of SEQ ID NO: 108 and the GH11 polypeptide of SEQ ID NO: 74. In an embodiment, the composition of the invention comprises the GH62 polypeptide of SEQ ID NO: 108 and the GH11 polypeptide of SEQ ID NO: 75. In an embodiment, the composition of the invention comprises the GH62 polypeptide of SEQ ID NO: 108 and the GH11 polypeptide of SEQ ID NO: 78. In an embodiment, the composition of the invention comprises the GH62 polypeptide of SEQ ID NO: 108 and the GH11 polypeptide of SEQ ID NO: 81. In an embodiment, the composition of the invention comprises the GH62 polypeptide of SEQ ID NO: 108 and the GH11 polypeptide of SEQ ID NO: 84. In an embodiment, the composition of the invention comprises the GH62 polypeptide of SEQ ID NO: 108 and the GH11 polypeptide of SEQ ID NO: 87. In an embodiment, the composition of the invention comprises the GH62 polypeptide of SEQ ID NO: 108 and the GH11 polypeptide of SEQ ID NO: 88. In an embodiment, the composition of the invention comprises the GH62 polypeptide of SEQ ID NO: 108 and the GH11 polypeptide of SEQ ID NO: 89. In an embodiment, the composition of the invention comprises the GH62 polypeptide of SEQ ID NO: 108 and the GH10 polypeptide of SEQ ID NO: 95. In an embodiment, the composition of the invention comprises the GH62 polypeptide of SEQ ID NO: 108 and the GH11 polypeptide of SEQ ID NO: 96. In an embodiment, the composition of the invention comprises the GH62 polypeptide of SEQ ID NO: 108 and the GH11 polypeptide of SEQ ID NO: 99. In an embodiment, the composition of the invention comprises the GH62 polypeptide of SEQ ID NO: 108 and the GH10 polypeptide of SEQ ID NO: 102. In an embodiment, the composition of the invention comprises the GH62 polypeptide of SEQ ID NO: 108 and the GH10 polypeptide of SEQ ID NO: 180.

In an embodiment, the composition of the invention comprises the GH62 polypeptide of SEQ ID NO: 114 and the GH10 polypeptide of SEQ ID NO: 70. In an embodiment, the composition of the invention comprises the GH62 polypeptide of SEQ ID NO: 114 and the GH10 polypeptide of SEQ ID NO: 71. In an embodiment, the composition of the invention comprises the GH62 polypeptide of SEQ ID NO: 114 and the GH10 polypeptide of SEQ ID NO: 72. In an embodiment, the composition of the invention comprises the GH62 polypeptide of SEQ ID NO: 114 and the GH11 polypeptide of SEQ ID NO: 73. In an embodiment, the composition of the invention comprises the GH62 polypeptide of SEQ ID NO: 114 and the GH11 polypeptide of SEQ ID NO: 74. In an embodiment, the composition of the invention comprises the GH62 polypeptide of SEQ ID NO: 114 and the GH11 polypeptide of SEQ ID NO: 75. In an embodiment, the composition of the invention comprises the GH62 polypeptide of SEQ ID NO: 114 and the GH11 polypeptide of SEQ ID NO: 78. In an embodiment, the composition of the invention comprises the GH62 polypeptide of SEQ ID NO: 114 and the GH11 polypeptide of SEQ ID NO: 81. In an embodiment, the composition of the invention comprises the GH62 polypeptide of SEQ ID NO: 114 and the GH11 polypeptide of SEQ ID NO: 84. In an embodiment, the composition of the invention comprises the GH62 polypeptide of SEQ ID NO: 114 and the GH11 polypeptide of SEQ ID NO: 87. In an embodiment, the composition of the invention comprises the GH62 polypeptide of SEQ ID NO: 114 and the GH11 polypeptide of SEQ ID NO: 88. In an embodiment, the composition of the invention comprises the GH62 polypeptide of SEQ ID NO: 114 and the GH11 polypeptide of SEQ ID NO: 89. In an embodiment, the composition of the invention comprises the GH62 polypeptide of SEQ ID NO: 114 and the GH10 polypeptide of SEQ ID NO: 95. In an embodiment, the composition of the invention comprises the GH62 polypeptide of SEQ ID NO: 114 and the GH11 polypeptide of SEQ ID NO: 96. In an embodiment, the composition of the invention comprises the GH62 polypeptide of SEQ ID NO: 114 and the GH11 polypeptide of SEQ ID NO: 99. In an embodiment, the composition of the invention comprises the GH62 polypeptide of SEQ ID NO: 114 and the GH10 polypeptide of SEQ ID NO: 102. In an embodiment, the composition of the invention comprises the GH62 polypeptide of SEQ ID NO: 114 and the GH10 polypeptide of SEQ ID NO: 180.

In an embodiment, the composition of the invention comprises the GH62 polypeptide of SEQ ID NO: 120 and the GH10 polypeptide of SEQ ID NO: 70. In an embodiment, the composition of the invention comprises the GH62 polypeptide of SEQ ID NO: 120 and the GH10 polypeptide of SEQ ID NO: 71. In an embodiment, the composition of the invention comprises the GH62 polypeptide of SEQ ID NO: 120 and the GH10 polypeptide of SEQ ID NO: 72. In an embodiment, the composition of the invention comprises the GH62 polypeptide of SEQ ID NO: 120 and the GH11 polypeptide of SEQ ID NO: 73. In an embodiment, the composition of the invention comprises the GH62 polypeptide of SEQ ID NO: 120 and the GH11 polypeptide of SEQ ID NO: 74. In an embodiment, the composition of the invention comprises the GH62 polypeptide of SEQ ID NO: 120 and the GH11 polypeptide of SEQ ID NO: 75. In an embodiment, the composition of the invention comprises the GH62 polypeptide of SEQ ID NO: 120 and the GH11 polypeptide of SEQ ID NO: 78. In an embodiment, the composition of the invention comprises the GH62 polypeptide of SEQ ID NO: 120 and the GH11 polypeptide of SEQ ID NO: 81. In an embodiment, the composition of the invention comprises the GH62 polypeptide of SEQ ID NO: 120 and the GH11 polypeptide of SEQ ID NO: 84. In an embodiment, the composition of the invention comprises the GH62 polypeptide of SEQ ID NO: 120 and the GH11 polypeptide of SEQ ID NO: 87. In an embodiment, the composition of the invention comprises the GH62 polypeptide of SEQ ID NO: 120 and the GH11 polypeptide of SEQ ID NO: 88. In an embodiment, the composition of the invention comprises the GH62 polypeptide of SEQ ID NO: 120 and the GH11 polypeptide of SEQ ID NO: 89. In an embodiment, the composition of the invention comprises the GH62 polypeptide of SEQ ID NO: 120 and the GH10 polypeptide of SEQ ID NO: 95. In an embodiment, the composition of the invention comprises the GH62 polypeptide of SEQ ID NO: 120 and the GH11 polypeptide of SEQ ID NO: 96. In an embodiment, the composition of the invention comprises the GH62 polypeptide of SEQ ID NO: 120 and the GH11 polypeptide of SEQ ID NO: 99. In an embodiment, the composition of the invention comprises the GH62 polypeptide of SEQ ID NO: 120 and the GH10 polypeptide of SEQ ID NO: 102. In an embodiment, the composition of the invention comprises the GH62 polypeptide of SEQ ID NO: 120 and the GH10 polypeptide of SEQ ID NO: 180.

In an embodiment, the composition of the invention comprises the GH62 polypeptide of SEQ ID NO: 123 and the GH10 polypeptide of SEQ ID NO: 70. In an embodiment, the composition of the invention comprises the GH62 polypeptide of SEQ ID NO: 123 and the GH10 polypeptide of SEQ ID NO: 71. In an embodiment, the composition of the invention comprises the GH62 polypeptide of SEQ ID NO: 123 and the GH10 polypeptide of SEQ ID NO: 72. In an embodiment, the composition of the invention comprises the GH62 polypeptide of SEQ ID NO: 123 and the GH11 polypeptide of SEQ ID NO: 73. In an embodiment, the composition of the invention comprises the GH62 polypeptide of SEQ ID NO: 123 and the GH11 polypeptide of SEQ ID NO: 74. In an embodiment, the composition of the invention comprises the GH62 polypeptide of SEQ ID NO: 123 and the GH11 polypeptide of SEQ ID NO: 75. In an embodiment, the composition of the invention comprises the GH62 polypeptide of SEQ ID NO: 123 and the GH11 polypeptide of SEQ ID NO: 78. In an embodiment, the composition of the invention comprises the GH62 polypeptide of SEQ ID NO: 123 and the GH11 polypeptide of SEQ ID NO: 81. In an embodiment, the composition of the invention comprises the GH62 polypeptide of SEQ ID NO: 123 and the GH11 polypeptide of SEQ ID NO: 84. In an embodiment, the composition of the invention comprises the GH62 polypeptide of SEQ ID NO: 123 and the GH11 polypeptide of SEQ ID NO: 87. In an embodiment, the composition of the invention comprises the GH62 polypeptide of SEQ ID NO: 123 and the GH11 polypeptide of SEQ ID NO: 88. In an embodiment, the composition of the invention comprises the GH62 polypeptide of SEQ ID NO: 123 and the GH11 polypeptide of SEQ ID NO: 89. In an embodiment, the composition of the invention comprises the GH62 polypeptide of SEQ ID NO: 123 and the GH10 polypeptide of SEQ ID NO: 95. In an embodiment, the composition of the invention comprises the GH62 polypeptide of SEQ ID NO: 123 and the GH11 polypeptide of SEQ ID NO: 96. In an embodiment, the composition of the invention comprises the GH62 polypeptide of SEQ ID NO: 123 and the GH11 polypeptide of SEQ ID NO: 99. In an embodiment, the composition of the invention comprises the GH62 polypeptide of SEQ ID NO: 123 and the GH10 polypeptide of SEQ ID NO: 102. In an embodiment, the composition of the invention comprises the GH62 polypeptide of SEQ ID NO: 123 and the GH10 polypeptide of SEQ ID NO: 180.

In an embodiment, the composition of the invention comprises the GH62 polypeptide of SEQ ID NO: 126 and the GH10 polypeptide of SEQ ID NO: 70. In an embodiment, the composition of the invention comprises the GH62 polypeptide of SEQ ID NO: 126 and the GH10 polypeptide of SEQ ID NO: 71. In an embodiment, the composition of the invention comprises the GH62 polypeptide of SEQ ID NO: 126 and the GH10 polypeptide of SEQ ID NO: 72. In an embodiment, the composition of the invention comprises the GH62 polypeptide of SEQ ID NO: 126 and the GH11 polypeptide of SEQ ID NO: 73. In an embodiment, the composition of the invention comprises the GH62 polypeptide of SEQ ID NO: 126 and the GH11 polypeptide of SEQ ID NO: 74. In an embodiment, the composition of the invention comprises the GH62 polypeptide of SEQ ID NO: 126 and the GH11 polypeptide of SEQ ID NO: 75. In an embodiment, the composition of the invention comprises the GH62 polypeptide of SEQ ID NO: 126 and the GH11 polypeptide of SEQ ID NO: 78. In an embodiment, the composition of the invention comprises the GH62 polypeptide of SEQ ID NO: 126 and the GH11 polypeptide of SEQ ID NO: 81. In an embodiment, the composition of the invention comprises the GH62 polypeptide of SEQ ID NO: 126 and the GH11 polypeptide of SEQ ID NO: 84. In an embodiment, the composition of the invention comprises the GH62 polypeptide of SEQ ID NO: 126 and the GH11 polypeptide of SEQ ID NO: 87. In an embodiment, the composition of the invention comprises the GH62 polypeptide of SEQ ID NO: 126 and the GH11 polypeptide of SEQ ID NO: 88. In an embodiment, the composition of the invention comprises the GH62 polypeptide of SEQ ID NO: 126 and the GH11 polypeptide of SEQ ID NO: 89. In an embodiment, the composition of the invention comprises the GH62 polypeptide of SEQ ID NO: 126 and the GH10 polypeptide of SEQ ID NO: 95. In an embodiment, the composition of the invention comprises the GH62 polypeptide of SEQ ID NO: 126 and the GH11 polypeptide of SEQ ID NO: 96. In an embodiment, the composition of the invention comprises the GH62 polypeptide of SEQ ID NO: 126 and the GH11 polypeptide of SEQ ID NO: 99. In an embodiment, the composition of the invention comprises the GH62 polypeptide of SEQ ID NO: 126 and the GH10 polypeptide of SEQ ID NO: 102. In an embodiment, the composition of the invention comprises the GH62 polypeptide of SEQ ID NO: 126 and the GH10 polypeptide of SEQ ID NO: 180.

In an embodiment, the composition of the invention comprises the GH62 polypeptide of SEQ ID NO: 132 and the GH10 polypeptide of SEQ ID NO: 70. In an embodiment, the composition of the invention comprises the GH62 polypeptide of SEQ ID NO: 132 and the GH10 polypeptide of SEQ ID NO: 71. In an embodiment, the composition of the invention comprises the GH62 polypeptide of SEQ ID NO: 132 and the GH10 polypeptide of SEQ ID NO: 72. In an embodiment, the composition of the invention comprises the GH62 polypeptide of SEQ ID NO: 132 and the GH11 polypeptide of SEQ ID NO: 73. In an embodiment, the composition of the invention comprises the GH62 polypeptide of SEQ ID NO: 132 and the GH11 polypeptide of SEQ ID NO: 74. In an embodiment, the composition of the invention comprises the GH62 polypeptide of SEQ ID NO: 132 and the GH11 polypeptide of SEQ ID NO: 75. In an embodiment, the composition of the invention comprises the GH62 polypeptide of SEQ ID NO: 132 and the GH11 polypeptide of SEQ ID NO: 78. In an embodiment, the composition of the invention comprises the GH62 polypeptide of SEQ ID NO: 132 and the GH11 polypeptide of SEQ ID NO: 81. In an embodiment, the composition of the invention comprises the GH62 polypeptide of SEQ ID NO: 132 and the GH11 polypeptide of SEQ ID NO: 84. In an embodiment, the composition of the invention comprises the GH62 polypeptide of SEQ ID NO: 132 and the GH11 polypeptide of SEQ ID NO: 87. In an embodiment, the composition of the invention comprises the GH62 polypeptide of SEQ ID NO: 132 and the GH11 polypeptide of SEQ ID NO: 88. In an embodiment, the composition of the invention comprises the GH62 polypeptide of SEQ ID NO: 132 and the GH11 polypeptide of SEQ ID NO: 89. In an embodiment, the composition of the invention comprises the GH62 polypeptide of SEQ ID NO: 132 and the GH10 polypeptide of SEQ ID NO: 95. In an embodiment, the composition of the invention comprises the GH62 polypeptide of SEQ ID NO: 132 and the GH11 polypeptide of SEQ ID NO: 96. In an embodiment, the composition of the invention comprises the GH62 polypeptide of SEQ ID NO: 132 and the GH11 polypeptide of SEQ ID NO: 99. In an embodiment, the composition of the invention comprises the GH62 polypeptide of SEQ ID NO: 132 and the GH10 polypeptide of SEQ ID NO: 102. In an embodiment, the composition of the invention comprises the GH62 polypeptide of SEQ ID NO: 132 and the GH10 polypeptide of SEQ ID NO: 180.

In an embodiment, the composition of the invention comprises the GH62 polypeptide of SEQ ID NO: 138 and the GH10 polypeptide of SEQ ID NO: 70. In an embodiment, the composition of the invention comprises the GH62 polypeptide of SEQ ID NO: 138 and the GH10 polypeptide of SEQ ID NO: 71. In an embodiment, the composition of the invention comprises the GH62 polypeptide of SEQ ID NO: 138 and the GH10 polypeptide of SEQ ID NO: 72. In an embodiment, the composition of the invention comprises the GH62 polypeptide of SEQ ID NO: 138 and the GH11 polypeptide of SEQ ID NO: 73. In an embodiment, the composition of the invention comprises the GH62 polypeptide of SEQ ID NO: 138 and the GH11 polypeptide of SEQ ID NO: 74. In an embodiment, the composition of the invention comprises the GH62 polypeptide of SEQ ID NO: 138 and the GH11 polypeptide of SEQ ID NO: 75. In an embodiment, the composition of the invention comprises the GH62 polypeptide of SEQ ID NO: 138 and the GH11 polypeptide of SEQ ID NO: 78. In an embodiment, the composition of the invention comprises the GH62 polypeptide of SEQ ID NO: 138 and the GH11 polypeptide of SEQ ID NO: 81. In an embodiment, the composition of the invention comprises the GH62 polypeptide of SEQ ID NO: 138 and the GH11 polypeptide of SEQ ID NO: 84. In an embodiment, the composition of the invention comprises the GH62 polypeptide of SEQ ID NO: 138 and the GH11 polypeptide of SEQ ID NO: 87. In an embodiment, the composition of the invention comprises the GH62 polypeptide of SEQ ID NO: 138 and the GH11 polypeptide of SEQ ID NO: 88. In an embodiment, the composition of the invention comprises the GH62 polypeptide of SEQ ID NO: 138 and the GH11 polypeptide of SEQ ID NO: 89. In an embodiment, the composition of the invention comprises the GH62 polypeptide of SEQ ID NO: 138 and the GH10 polypeptide of SEQ ID NO: 95. In an embodiment, the composition of the invention comprises the GH62 polypeptide of SEQ ID NO: 138 and the GH11 polypeptide of SEQ ID NO: 96. In an embodiment, the composition of the invention comprises the GH62 polypeptide of SEQ ID NO: 138 and the GH11 polypeptide of SEQ ID NO: 99. In an embodiment, the composition of the invention comprises the GH62 polypeptide of SEQ ID NO: 138 and the GH10 polypeptide of SEQ ID NO: 102. In an embodiment, the composition of the invention comprises the GH62 polypeptide of SEQ ID NO: 138 and the GH10 polypeptide of SEQ ID NO: 180.

In an embodiment, the composition of the invention comprises the GH62 polypeptide of SEQ ID NO: 141 and the GH10 polypeptide of SEQ ID NO: 70. In an embodiment, the composition of the invention comprises the GH62 polypeptide of SEQ ID NO: 141 and the GH10 polypeptide of SEQ ID NO: 71. In an embodiment, the composition of the invention comprises the GH62 polypeptide of SEQ ID NO: 141 and the GH10 polypeptide of SEQ ID NO: 72. In an embodiment, the composition of the invention comprises the GH62 polypeptide of SEQ ID NO: 141 and the GH11 polypeptide of SEQ ID NO: 73. In an embodiment, the composition of the invention comprises the GH62 polypeptide of SEQ ID NO: 141 and the GH11 polypeptide of SEQ ID NO: 74. In an embodiment, the composition of the invention comprises the GH62 polypeptide of SEQ ID NO: 141 and the GH11 polypeptide of SEQ ID NO: 75. In an embodiment, the composition of the invention comprises the GH62 polypeptide of SEQ ID NO: 141 and the GH11 polypeptide of SEQ ID NO: 78. In an embodiment, the composition of the invention comprises the GH62 polypeptide of SEQ ID NO: 141 and the GH11 polypeptide of SEQ ID NO: 81. In an embodiment, the composition of the invention comprises the GH62 polypeptide of SEQ ID NO: 141 and the GH11 polypeptide of SEQ ID NO: 84. In an embodiment, the composition of the invention comprises the GH62 polypeptide of SEQ ID NO: 141 and the GH11 polypeptide of SEQ ID NO: 87. In an embodiment, the composition of the invention comprises the GH62 polypeptide of SEQ ID NO: 141 and the GH11 polypeptide of SEQ ID NO: 88. In an embodiment, the composition of the invention comprises the GH62 polypeptide of SEQ ID NO: 141 and the GH11 polypeptide of SEQ ID NO: 89. In an embodiment, the composition of the invention comprises the GH62 polypeptide of SEQ ID NO: 141 and the GH10 polypeptide of SEQ ID NO: 95. In an embodiment, the composition of the invention comprises the GH62 polypeptide of SEQ ID NO: 141 and the GH11 polypeptide of SEQ ID NO: 96. In an embodiment, the composition of the invention comprises the GH62 polypeptide of SEQ ID NO: 141 and the GH11 polypeptide of SEQ ID NO: 99. In an embodiment, the composition of the invention comprises the GH62 polypeptide of SEQ ID NO: 141 and the GH10 polypeptide of SEQ ID NO: 102. In an embodiment, the composition of the invention comprises the GH62 polypeptide of SEQ ID NO: 141 and the GH10 polypeptide of SEQ ID NO: 180.

In an embodiment, the composition of the invention comprises the GH62 polypeptide of SEQ ID NO: 147 and the GH10 polypeptide of SEQ ID NO: 70. In an embodiment, the composition of the invention comprises the GH62 polypeptide of SEQ ID NO: 147 and the GH10 polypeptide of SEQ ID NO: 71. In an embodiment, the composition of the invention comprises the GH62 polypeptide of SEQ ID NO: 147 and the GH10 polypeptide of SEQ ID NO: 72. In an embodiment, the composition of the invention comprises the GH62 polypeptide of SEQ ID NO: 147 and the GH11 polypeptide of SEQ ID NO: 73. In an embodiment, the composition of the invention comprises the GH62 polypeptide of SEQ ID NO: 147 and the GH11 polypeptide of SEQ ID NO: 74. In an embodiment, the composition of the invention comprises the GH62 polypeptide of SEQ ID NO: 147 and the GH11 polypeptide of SEQ ID NO: 75. In an embodiment, the composition of the invention comprises the GH62 polypeptide of SEQ ID NO: 147 and the GH11 polypeptide of SEQ ID NO: 78. In an embodiment, the composition of the invention comprises the GH62 polypeptide of SEQ ID NO: 147 and the GH11 polypeptide of SEQ ID NO: 81. In an embodiment, the composition of the invention comprises the GH62 polypeptide of SEQ ID NO: 147 and the GH11 polypeptide of SEQ ID NO: 84. In an embodiment, the composition of the invention comprises the GH62 polypeptide of SEQ ID NO: 147 and the GH11 polypeptide of SEQ ID NO: 87. In an embodiment, the composition of the invention comprises the GH62 polypeptide of SEQ ID NO: 147 and the GH11 polypeptide of SEQ ID NO: 88. In an embodiment, the composition of the invention comprises the GH62 polypeptide of SEQ ID NO: 147 and the GH11 polypeptide of SEQ ID NO: 89. In an embodiment, the composition of the invention comprises the GH62 polypeptide of SEQ ID NO: 147 and the GH10 polypeptide of SEQ ID NO: 95. In an embodiment, the composition of the invention comprises the GH62 polypeptide of SEQ ID NO: 147 and the GH11 polypeptide of SEQ ID NO: 96. In an embodiment, the composition of the invention comprises the GH62 polypeptide of SEQ ID NO: 147 and the GH11 polypeptide of SEQ ID NO: 99. In an embodiment, the composition of the invention comprises the GH62 polypeptide of SEQ ID NO: 147 and the GH10 polypeptide of SEQ ID NO: 102. In an embodiment, the composition of the invention comprises the GH62 polypeptide of SEQ ID NO: 147 and the GH10 polypeptide of SEQ ID NO: 180.

In an embodiment, the composition of the invention comprises the GH62 polypeptide of SEQ ID NO: 150 and the GH10 polypeptide of SEQ ID NO: 70. In an embodiment, the composition of the invention comprises the GH62 polypeptide of SEQ ID NO: 150 and the GH10 polypeptide of SEQ ID NO: 71. In an embodiment, the composition of the invention comprises the GH62 polypeptide of SEQ ID NO: 150 and the GH10 polypeptide of SEQ ID NO: 72. In an embodiment, the composition of the invention comprises the GH62 polypeptide of SEQ ID NO: 150 and the GH11 polypeptide of SEQ ID NO: 73. In an embodiment, the composition of the invention comprises the GH62 polypeptide of SEQ ID NO: 150 and the GH11 polypeptide of SEQ ID NO: 74. In an embodiment, the composition of the invention comprises the GH62 polypeptide of SEQ ID NO: 150 and the GH11 polypeptide of SEQ ID NO: 75. In an embodiment, the composition of the invention comprises the GH62 polypeptide of SEQ ID NO: 150 and the GH11 polypeptide of SEQ ID NO: 78. In an embodiment, the composition of the invention comprises the GH62 polypeptide of SEQ ID NO: 150 and the GH11 polypeptide of SEQ ID NO: 81. In an embodiment, the composition of the invention comprises the GH62 polypeptide of SEQ ID NO: 150 and the GH11 polypeptide of SEQ ID NO: 84. In an embodiment, the composition of the invention comprises the GH62 polypeptide of SEQ ID NO: 150 and the GH11 polypeptide of SEQ ID NO: 87. In an embodiment, the composition of the invention comprises the GH62 polypeptide of SEQ ID NO: 150 and the GH11 polypeptide of SEQ ID NO: 88. In an embodiment, the composition of the invention comprises the GH62 polypeptide of SEQ ID NO: 150 and the GH11 polypeptide of SEQ ID NO: 89. In an embodiment, the composition of the invention comprises the GH62 polypeptide of SEQ ID NO: 150 and the GH10 polypeptide of SEQ ID NO: 95. In an embodiment, the composition of the invention comprises the GH62 polypeptide of SEQ ID NO: 150 and the GH11 polypeptide of SEQ ID NO: 96. In an embodiment, the composition of the invention comprises the GH62 polypeptide of SEQ ID NO: 150 and the GH11 polypeptide of SEQ ID NO: 99. In an embodiment, the composition of the invention comprises the GH62 polypeptide of SEQ ID NO: 150 and the GH10 polypeptide of SEQ ID NO: 102. In an embodiment, the composition of the invention comprises the GH62 polypeptide of SEQ ID NO: 150 and the GH10 polypeptide of SEQ ID NO: 180.

In an embodiment, the composition of the invention comprises the GH62 polypeptide of SEQ ID NO: 156 and the GH10 polypeptide of SEQ ID NO: 70. In an embodiment, the composition of the invention comprises the GH62 polypeptide of SEQ ID NO: 156 and the GH10 polypeptide of SEQ ID NO: 71. In an embodiment, the composition of the invention comprises the GH62 polypeptide of SEQ ID NO: 156 and the GH10 polypeptide of SEQ ID NO: 72. In an embodiment, the composition of the invention comprises the GH62 polypeptide of SEQ ID NO: 156 and the GH11 polypeptide of SEQ ID NO: 73. In an embodiment, the composition of the invention comprises the GH62 polypeptide of SEQ ID NO: 156 and the GH11 polypeptide of SEQ ID NO: 74. In an embodiment, the composition of the invention comprises the GH62 polypeptide of SEQ ID NO: 156 and the GH11 polypeptide of SEQ ID NO: 75. In an embodiment, the composition of the invention comprises the GH62 polypeptide of SEQ ID NO: 156 and the GH11 polypeptide of SEQ ID NO: 78. In an embodiment, the composition of the invention comprises the GH62 polypeptide of SEQ ID NO: 156 and the GH11 polypeptide of SEQ ID NO: 81. In an embodiment, the composition of the invention comprises the GH62 polypeptide of SEQ ID NO: 156 and the GH11 polypeptide of SEQ ID NO: 84. In an embodiment, the composition of the invention comprises the GH62 polypeptide of SEQ ID NO: 156 and the GH11 polypeptide of SEQ ID NO: 87. In an embodiment, the composition of the invention comprises the GH62 polypeptide of SEQ ID NO: 156 and the GH11 polypeptide of SEQ ID NO: 88. In an embodiment, the composition of the invention comprises the GH62 polypeptide of SEQ ID NO: 156 and the GH11 polypeptide of SEQ ID NO: 89. In an embodiment, the composition of the invention comprises the GH62 polypeptide of SEQ ID NO: 156 and the GH10 polypeptide of SEQ ID NO: 95. In an embodiment, the composition of the invention comprises the GH62 polypeptide of SEQ ID NO: 156 and the GH11 polypeptide of SEQ ID NO: 96. In an embodiment, the composition of the invention comprises the GH62 polypeptide of SEQ ID NO: 156 and the GH11 polypeptide of SEQ ID NO: 99. In an embodiment, the composition of the invention comprises the GH62 polypeptide of SEQ ID NO: 156 and the GH10 polypeptide of SEQ ID NO: 102. In an embodiment, the composition of the invention comprises the GH62 polypeptide of SEQ ID NO: 156 and the GH10 polypeptide of SEQ ID NO: 180.

In an embodiment, the composition of the invention comprises the GH62 polypeptide of SEQ ID NO: 159 and the GH10 polypeptide of SEQ ID NO: 70. In an embodiment, the composition of the invention comprises the GH62 polypeptide of SEQ ID NO: 159 and the GH10 polypeptide of SEQ ID NO: 71. In an embodiment, the composition of the invention comprises the GH62 polypeptide of SEQ ID NO: 159 and the GH10 polypeptide of SEQ ID NO: 72. In an embodiment, the composition of the invention comprises the GH62 polypeptide of SEQ ID NO: 159 and the GH11 polypeptide of SEQ ID NO: 73. In an embodiment, the composition of the invention comprises the GH62 polypeptide of SEQ ID NO: 159 and the GH11 polypeptide of SEQ ID NO: 74. In an embodiment, the composition of the invention comprises the GH62 polypeptide of SEQ ID NO: 159 and the GH11 polypeptide of SEQ ID NO: 75. In an embodiment, the composition of the invention comprises the GH62 polypeptide of SEQ ID NO: 159 and the GH11 polypeptide of SEQ ID NO: 78. In an embodiment, the composition of the invention comprises the GH62 polypeptide of SEQ ID NO: 159 and the GH11 polypeptide of SEQ ID NO: 81. In an embodiment, the composition of the invention comprises the GH62 polypeptide of SEQ ID NO: 159 and the GH11 polypeptide of SEQ ID NO: 84. In an embodiment, the composition of the invention comprises the GH62 polypeptide of SEQ ID NO: 159 and the GH11 polypeptide of SEQ ID NO: 87. In an embodiment, the composition of the invention comprises the GH62 polypeptide of SEQ ID NO: 159 and the GH11 polypeptide of SEQ ID NO: 88. In an embodiment, the composition of the invention comprises the GH62 polypeptide of SEQ ID NO: 159 and the GH11 polypeptide of SEQ ID NO: 89. In an embodiment, the composition of the invention comprises the GH62 polypeptide of SEQ ID NO: 159 and the GH10 polypeptide of SEQ ID NO: 95. In an embodiment, the composition of the invention comprises the GH62 polypeptide of SEQ ID NO: 159 and the GH11 polypeptide of SEQ ID NO: 96. In an embodiment, the composition of the invention comprises the GH62 polypeptide of SEQ ID NO: 159 and the GH11 polypeptide of SEQ ID NO: 99. In an embodiment, the composition of the invention comprises the GH62 polypeptide of SEQ ID NO: 159 and the GH10 polypeptide of SEQ ID NO: 102. In an embodiment, the composition of the invention comprises the GH62 polypeptide of SEQ ID NO: 159 and the GH10 polypeptide of SEQ ID NO: 180.

In an embodiment, the composition of the invention comprises the GH62 polypeptide of SEQ ID NO: 162 and the GH10 polypeptide of SEQ ID NO: 70. In an embodiment, the composition of the invention comprises the GH62 polypeptide of SEQ ID NO: 162 and the GH10 polypeptide of SEQ ID NO: 71. In an embodiment, the composition of the invention comprises the GH62 polypeptide of SEQ ID NO: 162 and the GH10 polypeptide of SEQ ID NO: 72. In an embodiment, the composition of the invention comprises the GH62 polypeptide of SEQ ID NO: 162 and the GH11 polypeptide of SEQ ID NO: 73. In an embodiment, the composition of the invention comprises the GH62 polypeptide of SEQ ID NO: 162 and the GH11 polypeptide of SEQ ID NO: 74. In an embodiment, the composition of the invention comprises the GH62 polypeptide of SEQ ID NO: 162 and the GH11 polypeptide of SEQ ID NO: 75. In an embodiment, the composition of the invention comprises the GH62 polypeptide of SEQ ID NO: 162 and the GH11 polypeptide of SEQ ID NO: 78. In an embodiment, the composition of the invention comprises the GH62 polypeptide of SEQ ID NO: 162 and the GH11 polypeptide of SEQ ID NO: 81. In an embodiment, the composition of the invention comprises the GH62 polypeptide of SEQ ID NO: 162 and the GH11 polypeptide of SEQ ID NO: 84. In an embodiment, the composition of the invention comprises the GH62 polypeptide of SEQ ID NO: 162 and the GH11 polypeptide of SEQ ID NO: 87. In an embodiment, the composition of the invention comprises the GH62 polypeptide of SEQ ID NO: 162 and the GH11 polypeptide of SEQ ID NO: 88. In an embodiment, the composition of the invention comprises the GH62 polypeptide of SEQ ID NO: 162 and the GH11 polypeptide of SEQ ID NO: 89. In an embodiment, the composition of the invention comprises the GH62 polypeptide of SEQ ID NO: 162 and the GH10 polypeptide of SEQ ID NO: 95. In an embodiment, the composition of the invention comprises the GH62 polypeptide of SEQ ID NO: 162 and the GH11 polypeptide of SEQ ID NO: 96. In an embodiment, the composition of the invention comprises the GH62 polypeptide of SEQ ID NO: 162 and the GH11 polypeptide of SEQ ID NO: 99. In an embodiment, the composition of the invention comprises the GH62 polypeptide of SEQ ID NO: 162 and the GH10 polypeptide of SEQ ID NO: 102. In an embodiment, the composition of the invention comprises the GH62 polypeptide of SEQ ID NO: 162 and the GH10 polypeptide of SEQ ID NO: 180.

In an embodiment, the composition of the invention comprises the GH62 polypeptide of SEQ ID NO: 165 and the GH10 polypeptide of SEQ ID NO: 70. In an embodiment, the composition of the invention comprises the GH62 polypeptide of SEQ ID NO: 165 and the GH10 polypeptide of SEQ ID NO: 71. In an embodiment, the composition of the invention comprises the GH62 polypeptide of SEQ ID NO: 165 and the GH10 polypeptide of SEQ ID NO: 72. In an embodiment, the composition of the invention comprises the GH62 polypeptide of SEQ ID NO: 165 and the GH11 polypeptide of SEQ ID NO: 73. In an embodiment, the composition of the invention comprises the GH62 polypeptide of SEQ ID NO: 165 and the GH11 polypeptide of SEQ ID NO: 74. In an embodiment, the composition of the invention comprises the GH62 polypeptide of SEQ ID NO: 165 and the GH11 polypeptide of SEQ ID NO: 75. In an embodiment, the composition of the invention comprises the GH62 polypeptide of SEQ ID NO: 165 and the GH11 polypeptide of SEQ ID NO: 78. In an embodiment, the composition of the invention comprises the GH62 polypeptide of SEQ ID NO: 165 and the GH11 polypeptide of SEQ ID NO: 81. In an embodiment, the composition of the invention comprises the GH62 polypeptide of SEQ ID NO: 165 and the GH11 polypeptide of SEQ ID NO: 84. In an embodiment, the composition of the invention comprises the GH62 polypeptide of SEQ ID NO: 165 and the GH11 polypeptide of SEQ ID NO: 87. In an embodiment, the composition of the invention comprises the GH62 polypeptide of SEQ ID NO: 165 and the GH11 polypeptide of SEQ ID NO: 88. In an embodiment, the composition of the invention comprises the GH62 polypeptide of SEQ ID NO: 165 and the GH11 polypeptide of SEQ ID NO: 89. In an embodiment, the composition of the invention comprises the GH62 polypeptide of SEQ ID NO: 165 and the GH10 polypeptide of SEQ ID NO: 95. In an embodiment, the composition of the invention comprises the GH62 polypeptide of SEQ ID NO: 165 and the GH11 polypeptide of SEQ ID NO: 96. In an embodiment, the composition of the invention comprises the GH62 polypeptide of SEQ ID NO: 165 and the GH11 polypeptide of SEQ ID NO: 99. In an embodiment, the composition of the invention comprises the GH62 polypeptide of SEQ ID NO: 165 and the GH10 polypeptide of SEQ ID NO: 102. In an embodiment, the composition of the invention comprises the GH62 polypeptide of SEQ ID NO: 165 and the GH10 polypeptide of SEQ ID NO: 180.

In an embodiment, the composition of the invention comprises the GH62 polypeptide of SEQ ID NO: 168 and the GH10 polypeptide of SEQ ID NO: 70. In an embodiment, the composition of the invention comprises the GH62 polypeptide of SEQ ID NO: 168 and the GH10 polypeptide of SEQ ID NO: 71. In an embodiment, the composition of the invention comprises the GH62 polypeptide of SEQ ID NO: 168 and the GH10 polypeptide of SEQ ID NO: 72. In an embodiment, the composition of the invention comprises the GH62 polypeptide of SEQ ID NO: 168 and the GH11 polypeptide of SEQ ID NO: 73. In an embodiment, the composition of the invention comprises the GH62 polypeptide of SEQ ID NO: 168 and the GH11 polypeptide of SEQ ID NO: 74. In an embodiment, the composition of the invention comprises the GH62 polypeptide of SEQ ID NO: 168 and the GH11 polypeptide of SEQ ID NO: 75. In an embodiment, the composition of the invention comprises the GH62 polypeptide of SEQ ID NO: 168 and the GH11 polypeptide of SEQ ID NO: 78. In an embodiment, the composition of the invention comprises the GH62 polypeptide of SEQ ID NO: 168 and the GH11 polypeptide of SEQ ID NO: 81. In an embodiment, the composition of the invention comprises the GH62 polypeptide of SEQ ID NO: 168 and the GH11 polypeptide of SEQ ID NO: 84. In an embodiment, the composition of the invention comprises the GH62 polypeptide of SEQ ID NO: 168 and the GH11 polypeptide of SEQ ID NO: 87. In an embodiment, the composition of the invention comprises the GH62 polypeptide of SEQ ID NO: 168 and the GH11 polypeptide of SEQ ID NO: 88. In an embodiment, the composition of the invention comprises the GH62 polypeptide of SEQ ID NO: 168 and the GH11 polypeptide of SEQ ID NO: 89. In an embodiment, the composition of the invention comprises the GH62 polypeptide of SEQ ID NO: 168 and the GH10 polypeptide of SEQ ID NO: 95. In an embodiment, the composition of the invention comprises the GH62 polypeptide of SEQ ID NO: 168 and the GH11 polypeptide of SEQ ID NO: 96. In an embodiment, the composition of the invention comprises the GH62 polypeptide of SEQ ID NO: 168 and the GH11 polypeptide of SEQ ID NO: 99. In an embodiment, the composition of the invention comprises the GH62 polypeptide of SEQ ID NO: 168 and the GH10 polypeptide of SEQ ID NO: 102. In an embodiment, the composition of the invention comprises the GH62 polypeptide of SEQ ID NO: 168 and the GH10 polypeptide of SEQ ID NO: 180.

In an embodiment, the composition of the invention comprises the GH62 polypeptide of SEQ ID NO: 171 and the GH10 polypeptide of SEQ ID NO: 70. In an embodiment, the composition of the invention comprises the GH62 polypeptide of SEQ ID NO: 171 and the GH10 polypeptide of SEQ ID NO: 71. In an embodiment, the composition of the invention comprises the GH62 polypeptide of SEQ ID NO: 171 and the GH10 polypeptide of SEQ ID NO: 72. In an embodiment, the composition of the invention comprises the GH62 polypeptide of SEQ ID NO: 171 and the GH11 polypeptide of SEQ ID NO: 73. In an embodiment, the composition of the invention comprises the GH62 polypeptide of SEQ ID NO: 171 and the GH11 polypeptide of SEQ ID NO: 74. In an embodiment, the composition of the invention comprises the GH62 polypeptide of SEQ ID NO: 171 and the GH11 polypeptide of SEQ ID NO: 75. In an embodiment, the composition of the invention comprises the GH62 polypeptide of SEQ ID NO: 171 and the GH11 polypeptide of SEQ ID NO: 78. In an embodiment, the composition of the invention comprises the GH62 polypeptide of SEQ ID NO: 171 and the GH11 polypeptide of SEQ ID NO: 81. In an embodiment, the composition of the invention comprises the GH62 polypeptide of SEQ ID NO: 171 and the GH11 polypeptide of SEQ ID NO: 84. In an embodiment, the composition of the invention comprises the GH62 polypeptide of SEQ ID NO: 171 and the GH11 polypeptide of SEQ ID NO: 87. In an embodiment, the composition of the invention comprises the GH62 polypeptide of SEQ ID NO: 171 and the GH11 polypeptide of SEQ ID NO: 88. In an embodiment, the composition of the invention comprises the GH62 polypeptide of SEQ ID NO: 171 and the GH11 polypeptide of SEQ ID NO: 89. In an embodiment, the composition of the invention comprises the GH62 polypeptide of SEQ ID NO: 171 and the GH10 polypeptide of SEQ ID NO: 95. In an embodiment, the composition of the invention comprises the GH62 polypeptide of SEQ ID NO: 171 and the GH11 polypeptide of SEQ ID NO: 96. In an embodiment, the composition of the invention comprises the GH62 polypeptide of SEQ ID NO: 171 and the GH11 polypeptide of SEQ ID NO: 99. In an embodiment, the composition of the invention comprises the GH62 polypeptide of SEQ ID NO: 171 and the GH10 polypeptide of SEQ ID NO: 102. In an embodiment, the composition of the invention comprises the GH62 polypeptide of SEQ ID NO: 171 and the GH10 polypeptide of SEQ ID NO: 180.

In an embodiment, the composition of the invention comprises the GH62 polypeptide of SEQ ID NO: 174 and the GH10 polypeptide of SEQ ID NO: 70. In an embodiment, the composition of the invention comprises the GH62 polypeptide of SEQ ID NO: 174 and the GH10 polypeptide of SEQ ID NO: 71. In an embodiment, the composition of the invention comprises the GH62 polypeptide of SEQ ID NO: 174 and the GH10 polypeptide of SEQ ID NO: 72. In an embodiment, the composition of the invention comprises the GH62 polypeptide of SEQ ID NO: 174 and the GH11 polypeptide of SEQ ID NO: 73. In an embodiment, the composition of the invention comprises the GH62 polypeptide of SEQ ID NO: 174 and the GH11 polypeptide of SEQ ID NO: 74. In an embodiment, the composition of the invention comprises the GH62 polypeptide of SEQ ID NO: 174 and the GH11 polypeptide of SEQ ID NO: 75. In an embodiment, the composition of the invention comprises the GH62 polypeptide of SEQ ID NO: 174 and the GH11 polypeptide of SEQ ID NO: 78. In an embodiment, the composition of the invention comprises the GH62 polypeptide of SEQ ID NO: 174 and the GH11 polypeptide of SEQ ID NO: 81. In an embodiment, the composition of the invention comprises the GH62 polypeptide of SEQ ID NO: 174 and the GH11 polypeptide of SEQ ID NO: 84. In an embodiment, the composition of the invention comprises the GH62 polypeptide of SEQ ID NO: 174 and the GH11 polypeptide of SEQ ID NO: 87. In an embodiment, the composition of the invention comprises the GH62 polypeptide of SEQ ID NO: 174 and the GH11 polypeptide of SEQ ID NO: 88. In an embodiment, the composition of the invention comprises the GH62 polypeptide of SEQ ID NO: 174 and the GH11 polypeptide of SEQ ID NO: 89. In an embodiment, the composition of the invention comprises the GH62 polypeptide of SEQ ID NO: 174 and the GH10 polypeptide of SEQ ID NO: 95. In an embodiment, the composition of the invention comprises the GH62 polypeptide of SEQ ID NO: 174 and the GH11 polypeptide of SEQ ID NO: 96. In an embodiment, the composition of the invention comprises the GH62 polypeptide of SEQ ID NO: 174 and the GH11 polypeptide of SEQ ID NO: 99. In an embodiment, the composition of the invention comprises the GH62 polypeptide of SEQ ID NO: 174 and the GH10 polypeptide of SEQ ID NO: 102. In an embodiment, the composition of the invention comprises the GH62 polypeptide of SEQ ID NO: 174 and the GH10 polypeptide of SEQ ID NO: 180.

In a further preferred embodiment, the composition of the invention comprises one or more GH10 polypeptides selected from the list consisting of SEQ ID NO: 71, SEQ ID NO: 72 and SEQ ID NO: 180 and one or more GH62 polypeptides selected from the list consisting of SEQ ID NO: 9, SEQ ID NO: 21, SEQ ID NO: 24, SEQ ID NO: 27, SEQ ID NO: 45, SEQ ID NO: 51, SEQ ID NO: 57, SEQ ID NO: 69, SEQ ID NO: 105, SEQ ID NO: 123, SEQ ID NO: 129, SEQ ID NO: 138, SEQ ID NO: 147, SEQ ID NO: 153, SEQ ID NO: 156, SEQ ID NO: 159, SEQ ID NO: 162, SEQ ID NO: 165, SEQ ID NO: 171 and SEQ ID NO: 174.

In a further preferred embodiment, the animal feed or animal feed additive of the invention comprises one or more GH10 polypeptides selected from the list consisting of SEQ ID NO: 71, SEQ ID NO: 72 and SEQ ID NO: 180 and one or more GH62 polypeptides selected from the list consisting of SEQ ID NO: 9, SEQ ID NO: 21, SEQ ID NO: 24, SEQ ID NO: 27, SEQ ID NO: 45, SEQ ID NO: 51, SEQ ID NO: 57, SEQ ID NO: 69, SEQ ID NO: 105, SEQ ID NO: 123, SEQ ID NO: 129, SEQ ID NO: 138, SEQ ID NO: 147, SEQ ID NO: 153, SEQ ID NO: 156, SEQ ID NO: 159, SEQ ID NO: 162, SEQ ID NO: 165, SEQ ID NO: 171 and SEQ ID NO: 174. In an embodiment, the GH10 polypeptide is dosed at 0.01-200 mg enzyme protein per kg animal feed and the GH62 polypeptide is dosed at 0.01-200 mg enzyme protein per kg animal feed.

In a further preferred embodiment, the composition of the invention comprises the GH11 polypeptide of SEQ ID NO: 73 and one or more GH62 polypeptides selected from the list consisting of SEQ ID NO: 24, SEQ ID NO: 33, SEQ ID NO: 39, SEQ ID NO: 45, SEQ ID NO: 51, SEQ ID NO: 69, SEQ ID NO: 105, SEQ ID NO: 111, SEQ ID NO: 117, SEQ ID NO: 123, SEQ ID NO: 129, SEQ ID NO: 138, SEQ ID NO: 144, SEQ ID NO: 147, SEQ ID NO: 153, SEQ ID NO: 156, SEQ ID NO: 159, SEQ ID NO: 162, SEQ ID NO: 165, SEQ ID NO: 171 and SEQ ID NO: 174.

In a further preferred embodiment, the animal feed or animal feed additive of the invention comprises the GH11 polypeptide of SEQ ID NO: 73 and one or more GH62 polypeptides selected from the list consisting of SEQ ID NO: 24, SEQ ID NO: 33, SEQ ID NO: 39, SEQ ID NO: 45, SEQ ID NO: 51, SEQ ID NO: 69, SEQ ID NO: 105, SEQ ID NO: 111, SEQ ID NO: 117, SEQ ID NO: 123, SEQ ID NO: 129, SEQ ID NO: 138, SEQ ID NO: 144, SEQ ID NO: 147, SEQ ID NO: 153, SEQ ID NO: 156, SEQ ID NO: 159, SEQ ID NO: 162, SEQ ID NO: 165, SEQ ID NO: 171 and SEQ ID NO: 174. In an embodiment, the GH10 polypeptide is dosed at 0.01-200 mg enzyme protein per kg animal feed and the GH62 polypeptide is dosed at 0.01-200 mg enzyme protein per kg animal feed.

In a further preferred embodiment, the composition of the invention comprises one or more GH11 polypeptides selected from the list consisting of SEQ ID NO: 75, SEQ ID NO: 78, SEQ ID NO: 81, SEQ ID NO: 87, SEQ ID NO: 88, SEQ ID NO: 96 and SEQ ID NO: 99 and one or more GH62 polypeptides selected from the list consisting of SEQ ID NO: 21, SEQ ID NO: 24, SEQ ID NO: 27, SEQ ID NO: 33, SEQ ID NO: 39, SEQ ID NO: 45, SEQ ID NO: 51, SEQ ID NO: 57, SEQ ID NO: 63, SEQ ID NO: 69, SEQ ID NO: 105, SEQ ID NO: 111, SEQ ID NO: 117, SEQ ID NO: 123, SEQ ID NO: 129, SEQ ID NO: 138, SEQ ID NO: 144, SEQ ID NO: 147, SEQ ID NO: 153, SEQ ID NO: 156, SEQ ID NO: 159, SEQ ID NO: 162, SEQ ID NO: 165, SEQ ID NO: 171 and SEQ ID NO: 174.

In a further preferred embodiment, the animal feed or animal feed additive of the invention comprises one or more GH11 polypeptides selected from the list consisting of SEQ ID NO: 75, SEQ ID NO: 78, SEQ ID NO: 81, SEQ ID NO: 87, SEQ ID NO: 88, SEQ ID NO: 96 and SEQ ID NO: 99 and one or more GH62 polypeptides selected from the list consisting of SEQ ID NO: 21, SEQ ID NO: 24, SEQ ID NO: 27, SEQ ID NO: 33, SEQ ID NO: 39, SEQ ID NO: 45, SEQ ID NO: 51, SEQ ID NO: 57, SEQ ID NO: 63, SEQ ID NO: 69, SEQ ID NO: 105, SEQ ID NO: 111, SEQ ID NO: 117, SEQ ID NO: 123, SEQ ID NO: 129, SEQ ID NO: 138, SEQ ID NO: 144, SEQ ID NO: 147, SEQ ID NO: 153, SEQ ID NO: 156, SEQ ID NO: 159, SEQ ID NO: 162, SEQ ID NO: 165, SEQ ID NO: 171 and SEQ ID NO: 174. In an embodiment, the GH10 polypeptide is dosed at 0.01-200 mg enzyme protein per kg animal feed and the GH62 polypeptide is dosed at 0.01-200 mg enzyme protein per kg animal feed.

In a further embodiment, the specific combinations of GH10 or GH11 polypeptides having xylanase activity and GH62 polypeptides having arabinofuranosidase activity as listed above solubilises at least 2.0%, such as at least 2.5%, at least 3.0%, at least 3.5%, at least 4.0%, at least 4.5%, at least 5.0%, at least 5.5%, or at least 6.0% xylose from DFDSM and solubilises at least 2 times more xylose from DFDSM than the GH10 or GH11 polypeptide can when the GH62 polypeptide is not present.

In a further embodiment, the specific combinations of GH10 or GH11 polypeptides having xylanase activity and GH62 polypeptides having arabinofuranosidase activity as listed above solubilises at least 2.0%, such as at least 2.5%, at least 3.0%, at least 3.5%, at least 4.0%, at least 4.5%, at least 5.0%, at least 5.5%, or at least 6.0% xylose from DFDSM and solubilises at least 2.25 times more xylose from DFDSM than the GH10 or GH11 polypeptide can when the GH62 polypeptide is not present.

In a further embodiment, the specific combinations of GH10 or GH11 polypeptides having xylanase activity and GH62 polypeptides having arabinofuranosidase activity as listed above solubilises at least 2.0%, such as at least 2.5%, at least 3.0%, at least 3.5%, at least 4.0%, at least 4.5%, at least 5.0%, at least 5.5%, or at least 6.0% xylose from DFDSM and solubilises at least 2.5 times more xylose from DFDSM than the GH10 or GH11 polypeptide can when the GH62 polypeptide is not present.

In a further embodiment, the specific combinations of GH10 or GH11 polypeptides having xylanase activity and GH62 polypeptides having arabinofuranosidase activity as listed above solubilises at least 2.0%, such as at least 2.5%, at least 3.0%, at least 3.5%, at least 4.0%, at least 4.5%, at least 5.0%, at least 5.5%, or at least 6.0% xylose from DFDSM and solubilises at least 2.75 times more xylose from DFDSM than the GH10 or GH11 polypeptide can when the GH62 polypeptide is not present.

In a further embodiment, the specific combinations of GH10 or GH11 polypeptides having xylanase activity and GH62 polypeptides having arabinofuranosidase activity as listed above solubilises at least 2.0%, such as at least 2.5%, at least 3.0%, at least 3.5%, at least 4.0%, at least 4.5%, at least 5.0%, at least 5.5%, or at least 6.0% xylose from DFDSM and solubilises at least 3 times more xylose from DFDSM than the GH10 or GH11 polypeptide can when the GH62 polypeptide is not present.

In a further embodiment, the specific combinations of GH10 or GH11 polypeptides having xylanase activity and GH62 polypeptides having arabinofuranosidase activity as listed above solubilises at least 2.0%, such as at least 2.5%, at least 3.0%, at least 3.5%, at least 4.0%, at least 4.5%, at least 5.0%, at least 5.5%, or at least 6.0% xylose from DFDSM and solubilises at least 3.25 times more xylose from DFDSM than the GH10 or GH11 polypeptide can when the GH62 polypeptide is not present.

In a further embodiment, the specific combinations of GH10 or GH11 polypeptides having xylanase activity and GH62 polypeptides having arabinofuranosidase activity as listed above solubilises at least 2.0%, such as at least 2.5%, at least 3.0%, at least 3.5%, at least 4.0%, at least 4.5%, at least 5.0%, at least 5.5%, or at least 6.0% xylose from DFDSM and solubilises at least 3.5 times more xylose from DFDSM than the GH10 or GH11 polypeptide can when the GH62 polypeptide is not present.

In a further embodiment, the specific combinations of GH10 or GH11 polypeptides having xylanase activity and GH62 polypeptides having arabinofuranosidase activity as listed above solubilises at least 2.0%, such as at least 2.5%, at least 3.0%, at least 3.5%, at least 4.0%, at least 4.5%, at least 5.0%, at least 5.5%, or at least 6.0% xylose from DFDSM and solubilises at least 3.75 times more xylose from DFDSM than the GH10 or GH11 polypeptide can when the GH62 polypeptide is not present.

In a further embodiment, the specific combinations of GH10 or GH11 polypeptides having xylanase activity and GH62 polypeptides having arabinofuranosidase activity as listed above solubilises at least 2.0%, such as at least 2.5%, at least 3.0%, at least 3.5%, at least 4.0%, at least 4.5%, at least 5.0%, at least 5.5%, or at least 6.0% xylose from DFDSM and solubilises at least 4 times more xylose from DFDSM than the GH10 or GH11 polypeptide can when the GH62 polypeptide is not present.

Polypeptides Having Arabinofuranosidase Activity

In a second aspect, the invention relates to polypeptides having arabinofuranosidase activity and having a sequence identity to the mature polypeptide of SEQ ID NO: 11 of at least 85%, e.g., at least 86%, at least 87%, at least 88%, at least 89%, at least 90%, at least 91%, at least 92%, at least 93%, at least 94%, at least 95%, at least 96%, at least 97%, at least 98%, at least 99%, which have arabinofuranosidase activity. In one embodiment, the polypeptides differ by up to 45 amino acids, e.g., between 1 and 45 amino acids, such as 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44 or 45 amino acids from the mature polypeptide of SEQ ID NO: 11.

In a continuation of the second aspect, the invention further relates to polypeptides having a sequence identity to SEQ ID NO: 12 of at least 85% which have arabinofuranosidase activity. In an embodiment, the polypeptide has a sequence identity to SEQ ID NO: 12 of at least 86%. In an embodiment, the polypeptide has a sequence identity to SEQ ID NO: 12 of at least 87%. In an embodiment, the polypeptide has a sequence identity to SEQ ID NO: 12 of at least 88%. In an embodiment, the polypeptide has a sequence identity to SEQ ID NO: 12 of at least 89%. In an embodiment, the polypeptide has a sequence identity to SEQ ID NO: 12 of at least 90%. In an embodiment, the polypeptide has a sequence identity to SEQ ID NO: 12 of at least 91%. In an embodiment, the polypeptide has a sequence identity to SEQ ID NO: 12 of at least 92%. In an embodiment, the polypeptide has a sequence identity to SEQ ID NO: 12 of at least 93%. In an embodiment, the polypeptide has a sequence identity to SEQ ID NO: 12 of at least 94%. In an embodiment, the polypeptide has a sequence identity to SEQ ID NO: 12 of at least 95%. In an embodiment, the polypeptide has a sequence identity to SEQ ID NO: 12 of at least 96%. In an embodiment, the polypeptide has a sequence identity to SEQ ID NO: 12 of at least 97%. In an embodiment, the polypeptide has a sequence identity to SEQ ID NO: 12 of at least 98%. In an embodiment, the polypeptide has a sequence identity to SEQ ID NO: 12 of at least 99%.

In one embodiment, the polypeptides differ by up to 45 amino acids, e.g., between 1 and 50 amino acids, such as 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44 or 45 amino acids from SEQ ID NO: 12. In an embodiment, the polypeptide has at least 60%, at least 70%, at least 75%, at least 80%, at least 85%, at least 90%, at least 95%, or at least 100% of the activity of the polypeptide of SEQ ID NO: 12.

In one embodiment, the polypeptide preferably comprises or consists of the amino acid sequence of SEQ ID NO: 11 and/or SEQ ID NO: 12 or an allelic variant thereof; comprises the amino acid sequence of SEQ ID NO: 11 and/or SEQ ID NO: 12 and a N-terminal and/or C-terminal His-tag and/or HQ-tag; or is a fragment thereof having arabinofuranosidase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of the mature polypeptide of SEQ ID NO: 12. In another embodiment, the polypeptide comprises or consists of amino acids 1 to 303 of SEQ ID NO: 11. In another embodiment, the polypeptide comprises or consists of amino acids 1 to 303 of SEQ ID NO: 12. In an embodiment, the polypeptide has been isolated.

In a continuation of the second aspect, the invention relates to a polypeptide having arabinofuranosidase activity encoded by a polynucleotide that hybridizes under high stringency conditions or very high stringency conditions with (i) the mature polypeptide coding sequence of SEQ ID NO: 10 or (ii) the full-length complement of (i). (Sambrook et al., 1989, *Molecular Cloning, A Laboratory Manual*, 2d edition, Cold Spring Harbor, N.Y.). In an embodiment, the polypeptide has been isolated.

In a continuation of the second aspect, the invention relates to a polypeptide having arabinofuranosidase activity encoded by a polynucleotide having a sequence identity to the mature polypeptide coding sequence of SEQ ID NO: 10 or the cDNA sequence thereof of at least 85%, e.g., at least 86%, at least 87%, at least 88%, at least 89%, at least 90%, at least 91%, at least 92%, at least 93%, at least 94%, at least 95%, at least 96%, at least 97%, at least 98%, at least 99%, or 100%. In a further embodiment, the polypeptide has been isolated.

In a continuation of the second aspect, the invention relates to variants of SEQ ID NO: 12 having arabinofuranosidase activity comprising one or more amino acid substitutions, and/or one or more amino acid deletions, and/or one or more amino acid insertions or any combination thereof at one or more (e.g., several) positions. In an embodiment, the number of positions comprising one or more amino acid substitutions, and/or one or more amino acid deletions, and/or one or more amino acid insertions or any combination thereof in SEQ ID NO: 12 is not more than 45, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44 or 45. In an embodiment, the number of positions comprising one or more amino acid substitutions, and/or one or more amino acid deletions, and/or one or more amino acid insertions or any combination thereof in SEQ ID NO: 12 is not more than 10, e.g., 1, 2, 3, 4, 5, 6, 7, 8, 9 or 10. In another embodiment, the number of substitutions, deletions, and/or insertions in SEQ ID NO: 12 is not more than 10, e.g., 1, 2, 3, 4, 5, 6, 7, 8, 9 or 10. In a further embodiment, the number of substitutions, preferably conservative substitutions, in SEQ ID NO: 12 is not more than 10, e.g., 1, 2, 3, 4, 5, 6, 7, 8, 9 or 10. In an embodiment, the variant has at least 60%, at least 70%, at least 75%, at least 80%, at least 85%, at least 90%, at least 95%, or at least 100% of the activity of the polypeptide of SEQ ID NO: 12.

The amino acid changes may be of a minor nature, that is conservative amino acid substitutions or insertions that do not significantly affect the folding and/or activity of the protein; small deletions, typically of 1-30 amino acids; small amino- or carboxyl-terminal extensions, such as an amino-terminal methionine residue; a small linker peptide of up to 20-25 residues; or a small extension that facilitates purification by changing net charge or another function, such as a poly-histidine tract, an antigenic epitope or a binding domain.

Examples of conservative substitutions are within the groups of basic amino acids (arginine, lysine and histidine), acidic amino acids (glutamic acid and aspartic acid), polar amino acids (glutamine and asparagine), hydrophobic amino acids (leucine, isoleucine and valine), aromatic amino acids (phenylalanine, tryptophan and tyrosine), and small amino acids (glycine, alanine, serine, threonine and methionine). Amino acid substitutions that do not generally alter specific activity are known in the art and are described, for example, by H. Neurath and R. L. Hill, 1979, In, *The Proteins*, Academic Press, New York. Common substitutions are Ala/Ser, Val/Ile, Asp/Glu, Thr/Ser, Ala/Gly, Ala/Thr, Ser/Asn, Ala/Val, Ser/Gly, Tyr/Phe, Ala/Pro, Lys/Arg, Asp/Asn, Leu/Ile, Leu/Val, Ala/Glu, and Asp/Gly.

Alternatively, the amino acid changes are of such a nature that the physico-chemical properties of the polypeptides are altered. For example, amino acid changes may improve the thermal stability of the polypeptide, alter the substrate specificity, change the pH optimum, and the like.

Essential amino acids in a polypeptide can be identified according to procedures known in the art, such as site-directed mutagenesis or alanine-scanning mutagenesis (Cunningham and Wells, 1989, *Science* 244: 1081-1085). In the latter technique, single alanine mutations are introduced at every residue in the molecule, and the resultant mutant molecules are tested for arabinofuranosidase activity to identify amino acid residues that are critical to the activity of the molecule. See also, Hilton et al., 1996, *J. Biol. Chem.* 271: 4699-4708. The active site of the enzyme or other biological interaction can also be determined by physical analysis of structure, as determined by such techniques as nuclear magnetic resonance, crystallography, electron diffraction, or photoaffinity labelling, in conjunction with mutation of putative contact site amino acids. See, for example, de Vos et al., 1992, *Science* 255: 306-312; Smith et al., 1992, *J. Mol. Biol.* 224: 899-904; Wlodaver et al., 1992, *FEBS Lett.* 309: 59-64. The identity of essential amino acids can also be inferred from an alignment with a related polypeptide.

Single or multiple amino acid substitutions, deletions, and/or insertions can be made and tested using known methods of mutagenesis, recombination, and/or shuffling, followed by a relevant screening procedure, such as those disclosed by Reidhaar-Olson and Sauer, 1988, *Science* 241: 53-57; Bowie and Sauer, 1989, *Proc. Natl. Acad. Sci. USA* 86: 2152-2156; WO 95/17413; or WO 95/22625. Other methods that can be used include error-prone PCR, phage display (e.g., Lowman et al., 1991, *Biochemistry* 30: 10832-10837; U.S. Pat. No. 5,223,409; WO 92/06204), and region-directed mutagenesis (Derbyshire et al., 1986, *Gene* 46: 145; Ner et al., 1988, *DNA* 7: 127).

Mutagenesis/shuffling methods can be combined with high-throughput, automated screening methods to detect activity of cloned, mutagenized polypeptides expressed by host cells (Ness et al., 1999, *Nature Biotechnology* 17: 893-896). Mutagenized DNA molecules that encode active polypeptides can be recovered from the host cells and rapidly sequenced using standard methods in the art. These methods allow the rapid determination of the importance of individual amino acid residues in a polypeptide.

The polypeptide may be a hybrid polypeptide in which a region of one polypeptide is fused at the N-terminus or the C-terminus of a region of another polypeptide.

The polypeptide may be a fusion polypeptide or cleavable fusion polypeptide in which another polypeptide is fused at the N-terminus or the C-terminus of the polypeptide of the present invention. A fusion polypeptide is produced by fusing a polynucleotide encoding another polypeptide to a polynucleotide of the present invention. Techniques for producing fusion polypeptides are known in the art, and include ligating the coding sequences encoding the polypeptides so that they are in frame and that expression of the fusion polypeptide is under control of the same promoter(s) and terminator. Fusion polypeptides may also be constructed using intein technology in which fusion polypeptides are created post-translationally (Cooper et al., 1993, *EMBO J.* 12: 2575-2583; Dawson et al., 1994, *Science* 266: 776-779).

A fusion polypeptide can further comprise a cleavage site between the two polypeptides. Upon secretion of the fusion protein, the site is cleaved releasing the two polypeptides. Examples of cleavage sites include, but are not limited to, the sites disclosed in Martin et al., 2003, *J. Ind. Microbiol. Biotechnol.* 3: 568-576; Svetina et al., 2000, *J. Biotechnol.* 76: 245-251; Rasmussen-Wilson et al., 1997, *Appl. Environ. Microbiol.* 63: 3488-3493; Ward et al., 1995, *Biotechnology* 13: 498-503; and Contreras et al., 1991, *Biotechnology* 9: 378-381; Eaton et al., 1986, Biochemistry 25: 505-512; Collins-Racie et al., 1995, *Biotechnology* 13: 982-987; Carter et al., 1989, *Proteins: Structure, Function, and Genetics* 6: 240-248; and Stevens, 2003, *Drug Discovery World* 4: 35-48.

Carbohydrate molecules are often attached to a polypeptide from a fungal source during post-translational modification. In order to aid mass spectrometry analysis, the polypeptide can be incubated with an endoglycosidase to deglycosylate each N-linked position. For every deglycosylated N-linked site, one N-acetyl hexosamine remains on the protein backbone.

In an embodiment, the polypeptide of the second aspect comprises the motif [H/Y][L/M]F[F/S][A/C/H/S/T/V][A/D/G/N/R]D[D/E/N]G (SEQ ID NO: 1), preferably the motif [H/Y]LF[F/S][A/S/V][A/D/G]DNG (SEQ ID NO: 2), more preferable the motif YLFF[A/V][A/G]DNG (SEQ ID NO: 3), or even more preferably the motif YLFFAGDNG (SEQ ID NO: 4).

In a third aspect, the invention relates to polypeptides having arabinofuranosidase activity and having a sequence identity to the mature polypeptide of SEQ ID NO: 23 of at least 97.6%, e.g., at least 97.9%, at least 98.2%, at least 98.5%, at least 98.8%, at least 91.1%, at least 99.4%, at least 99.7%, which have arabinofuranosidase activity. In one embodiment, the polypeptides differ by up to 7 amino acids, e.g., between 1 and 7 amino acids, such as 1, 2, 3, 4, 5, 6 or 7 amino acids from the mature polypeptide of SEQ ID NO: 23.

In a continuation of the third aspect, the invention further relates to polypeptides having a sequence identity to SEQ ID NO: 24 of at least 97.6% which have arabinofuranosidase activity. In an embodiment, the polypeptide has a sequence identity to SEQ ID NO: 24 of at least 97.9%. In an embodiment, the polypeptide has a sequence identity to SEQ ID NO: 24 of at least 98.2%. In an embodiment, the polypeptide has a sequence identity to SEQ ID NO: 24 of at least 98.5%. In an embodiment, the polypeptide has a sequence identity to SEQ ID NO: 24 of at least 98.8%. In an embodiment, the polypeptide has a sequence identity to SEQ ID NO: 24 of at least 99.1%. In an embodiment, the polypeptide has a sequence identity to SEQ ID NO: 24 of at least 99.4%. In an embodiment, the polypeptide has a sequence identity to SEQ ID NO: 24 of at least 99.7%.

In one embodiment, the polypeptides differ by up to 7 amino acids, e.g., between 1 and 7 amino acids, such as 1, 2, 3, 4, 5, 6 or 7 amino acids from SEQ ID NO: 24. In an embodiment, the polypeptide has at least 60%, at least 70%, at least 75%, at least 80%, at least 85%, at least 90%, at least 95%, or at least 100% of the activity of the polypeptide of SEQ ID NO: 24.

In one embodiment, the polypeptide preferably comprises or consists of the amino acid sequence of SEQ ID NO: 23 and/or SEQ ID NO: 24 or an allelic variant thereof; comprises the amino acid sequence of SEQ ID NO: 23 and/or SEQ ID NO: 24 and a N-terminal and/or C-terminal His-tag and/or HQ-tag; or is a fragment thereof having arabinofuranosidase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of the mature polypeptide of SEQ ID NO: 24. In another embodiment, the polypeptide comprises or consists of amino acids 1 to 302 of SEQ ID NO: 23. In another embodiment, the polypeptide comprises or consists of amino acids 1 to 302 of SEQ ID NO: 24. In an embodiment, the polypeptide has been isolated.

In a continuation of the third aspect, the invention relates to a polypeptide having arabinofuranosidase activity encoded by a polynucleotide that hybridizes under very high stringency conditions with (i) the mature polypeptide coding sequence of SEQ ID NO: 22 or (ii) the full-length complement of (i). In an embodiment, the polypeptide has been isolated.

In a continuation of the third aspect, the invention relates to a polypeptide having arabinofuranosidase activity encoded by a polynucleotide having a sequence identity to the mature polypeptide coding sequence of SEQ ID NO: 22 or the cDNA sequence thereof of at least 97.6%, e.g., at least 97.9%, at least 98.2%, at least 98.5%, at least 98.8%, at least 91.1%, at least 99.4%, at least 99.7%, or 100%. In a further embodiment, the polypeptide has been isolated.

In a continuation of the third aspect, the invention relates to variants of SEQ ID NO: 24 having arabinofuranosidase activity comprising one or more amino acid substitutions, and/or one or more amino acid deletions, and/or one or more amino acid insertions or any combination thereof at one or more (e.g., several) positions. In an embodiment, the number of positions comprising one or more amino acid substitutions, and/or one or more amino acid deletions, and/or one or more amino acid insertions or any combination thereof in SEQ ID NO: 24 is not more than 7, e.g., 1, 2, 3, 4, 5, 6 or 7. In another embodiment, the number of substitutions, deletions, and/or insertions in SEQ ID NO: 24 is not more than 7, e.g., 1, 2, 3, 4, 5, 6 or 7. In a further embodiment, the number of substitutions, preferably conservative substitutions, in SEQ ID NO: 24 is not more than 7, e.g., 1, 2, 3, 4, 5, 6 or 7. In an embodiment, the variant has at least 60%, at least 70%, at least 75%, at least 80%, at least 85%, at least 90%, at least 95%, or at least 100% of the activity of the polypeptide of SEQ ID NO: 24. Examples of amino acid changes and conservative substitutions are described in the second aspect of the invention.

In an embodiment, the polypeptide of the third aspect comprises the motif [H/Y][L/M]F[F/S][A/C/H/S/T/V][A/D/G/N/R]D[D/E/N]G (SEQ ID NO: 1), preferably the motif [H/Y]LF[F/S][A/S/V][A/D/G]DNG (SEQ ID NO: 2), more preferable the motif YLFF[A/V][A/G]DNG (SEQ ID NO: 3), or even more preferably the motif YLFFAGDNG (SEQ ID NO: 4).

In a fourth aspect, the invention relates to polypeptides having arabinofuranosidase activity and having a sequence identity to the mature polypeptide of SEQ ID NO: 26 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, which have arabinofuranosidase activity. In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 amino acids from the mature polypeptide of SEQ ID NO: 26.

In a continuation of the fourth aspect, the invention further relates to polypeptides having a sequence identity to SEQ ID NO: 27 of at least 80% which have arabinofuranosidase activity. In an embodiment, the polypeptide has a sequence identity to SEQ ID NO: 27 of at least 85%. In an embodiment, the polypeptide has a sequence identity to SEQ ID NO: 27 of at least 86%. In an embodiment, the polypeptide has a sequence identity to SEQ ID NO: 27 of at least 87%. In an embodiment, the polypeptide has a sequence identity to SEQ ID NO: 27 of at least 88%. In an embodiment, the polypeptide has a sequence identity to SEQ ID NO: 27 of at least 89%. In an embodiment, the polypeptide has a sequence identity to SEQ ID NO: 27 of at least 90%. In an embodiment, the polypeptide has a sequence identity to SEQ ID NO: 27 of at least 91%. In an embodiment, the polypeptide has a sequence identity to SEQ ID NO: 27 of at least 92%. In an embodiment, the polypeptide has a sequence identity to SEQ ID NO: 27 of at least 93%. In an embodiment, the polypeptide has a sequence identity to SEQ ID NO: 27 of at least 94%. In an embodiment, the polypeptide has a sequence identity to SEQ ID NO: 27 of at least 95%. In an embodiment, the polypeptide has a sequence identity to SEQ ID NO: 27 of at least 96%. In an embodiment, the polypeptide has a sequence identity to SEQ ID NO: 27 of at least 97%. In an embodiment, the polypeptide has a sequence identity to SEQ ID NO: 27 of at least 98%. In an embodiment, the polypeptide has a sequence identity to SEQ ID NO: 27 of at least 99%.

In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 amino acids from SEQ ID NO: 27. In an embodiment, the polypeptide has at least 60%, at least 70%, at least 75%, at least 80%, at least 85%, at least 90%, at least 95%, or at least 100% of the activity of the polypeptide of SEQ ID NO: 27.

In one embodiment, the polypeptide preferably comprises or consists of the amino acid sequence of SEQ ID NO: 26 and/or SEQ ID NO: 27 or an allelic variant thereof; comprises the amino acid sequence of SEQ ID NO: 26 and/or SEQ ID NO: 27 and a N-terminal and/or C-terminal His-tag and/or HQ-tag; or is a fragment thereof having arabinofuranosidase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of the mature polypeptide of SEQ ID NO: 27. In another embodiment, the polypeptide comprises or consists of amino acids 1 to 309 of SEQ ID NO: 26. In another embodiment, the polypeptide comprises or consists of amino acids 1 to 309 of SEQ ID NO: 27. In an embodiment, the polypeptide has been isolated.

In a continuation of the fourth aspect, the invention relates to a polypeptide having arabinofuranosidase activity encoded by a polynucleotide that hybridizes under high stringency conditions or very high stringency conditions with (i) the mature polypeptide coding sequence of SEQ ID NO: 25 or (ii) the full-length complement of (i). In an embodiment, the polypeptide has been isolated.

In a continuation of the fourth aspect, the invention relates to a polypeptide having arabinofuranosidase activity encoded by a polynucleotide having a sequence identity to the mature polypeptide coding sequence of SEQ ID NO: 25 or the cDNA sequence thereof of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. In a further embodiment, the polypeptide has been isolated.

In a continuation of the fourth aspect, the invention relates to variants of SEQ ID NO: 27 having arabinofuranosidase activity comprising one or more amino acid substitutions, and/or one or more amino acid deletions, and/or one or more amino acid insertions or any combination thereof at one or more (e.g., several) positions. In an embodiment, the number of positions comprising one or more amino acid substitutions, and/or one or more amino acid deletions, and/or one or more amino acid insertions or any combination thereof in SEQ ID NO: 27 is not more than 50, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50. In an embodiment, the number of positions comprising one or more amino acid substitutions, and/or one or more amino acid deletions, and/or one or more amino acid insertions or any combination thereof in SEQ ID NO: 27 is not more than 10, e.g., 1, 2, 3, 4, 5, 6, 7, 8, 9 or 10. In another embodiment, the number of substitutions, deletions, and/or insertions in SEQ ID NO: 27 is not more than 10, e.g., 1, 2, 3, 4, 5, 6, 7, 8, 9 or 10. In a further embodiment, the number of substitutions, preferably conservative substitutions, in SEQ ID NO: 27 is not more than 10, e.g., 1, 2, 3, 4, 5, 6, 7, 8, 9 or 10. In an embodiment, the variant has at least 60%, at least 70%, at least 75%, at least 80%, at least 85%, at least 90%, at least 95%, or at least 100% of the activity of the polypeptide of SEQ ID NO: 27. Examples of amino acid changes and conservative substitutions are described in the second aspect of the invention.

In an embodiment, the polypeptide of the fourth aspect comprises the motif [H/Y][L/M]F[F/S][A/C/H/S/T/V][A/D/G/N/R]D[D/E/N]G (SEQ ID NO: 1), preferably the motif [H/Y]LF[F/S][A/S/V][A/D/G]DNG (SEQ ID NO: 2), more preferable the motif YLFF[A/V][A/G]DNG (SEQ ID NO: 3), or even more preferably the motif YLFFAGDNG (SEQ ID NO: 4).

In a fifth aspect, the invention relates to polypeptides having arabinofuranosidase activity and having a sequence identity to the mature polypeptide of SEQ ID NO: 29 of at least 90%, e.g., at least 91%, at least 92%, at least 93%, at least 94%, at least 95%, at least 96%, at least 97%, at least 98%, at least 99%, which have arabinofuranosidase activity. In one embodiment, the polypeptides differ by up to 43 amino acids, e.g., between 1 and 43 amino acids, such as 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42 or 43 amino acids from the mature polypeptide of SEQ ID NO: 29.

In a continuation of the fifth aspect, the invention further relates to polypeptides having a sequence identity to SEQ ID NO: 30 of at least 90% which have arabinofuranosidase activity. In an embodiment, the polypeptide has a sequence identity to SEQ ID NO: 30 of at least 91%. In an embodiment, the polypeptide has a sequence identity to SEQ ID NO: 30 of at least 92%. In an embodiment, the polypeptide has a sequence identity to SEQ ID NO: 30 of at least 93%. In an embodiment, the polypeptide has a sequence identity to SEQ ID NO: 30 of at least 94%. In an embodiment, the polypeptide has a sequence identity to SEQ ID NO: 30 of at least 95%. In an embodiment, the polypeptide has a sequence identity to SEQ ID NO: 30 of at least 96%. In an embodiment, the polypeptide has a sequence identity to SEQ ID NO: 30 of at least 97%. In an embodiment, the polypeptide has a sequence identity to SEQ ID NO: 30 of at least 98%. In an embodiment, the polypeptide has a sequence identity to SEQ ID NO: 30 of at least 99%.

In one embodiment, the polypeptides differ by up to 43 amino acids, such as 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42 or 43 amino acids from SEQ ID NO: 30. In one embodiment, the polypeptides differ by up to 43 amino acids, such as 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42 or 43 amino acids from SEQ ID NO: 33. In an embodiment, the polypeptide has at least 60%, at least 70%, at least 75%, at least 80%, at least 85%, at least 90%, at least 95%, or at least 100% of the activity of the polypeptide of SEQ ID NO: 30.

In one embodiment, the polypeptide preferably comprises or consists of the amino acid sequence of SEQ ID NO: 29 and/or SEQ ID NO: 30 or an allelic variant thereof; comprises the amino acid sequence of SEQ ID NO: 29 and/or SEQ ID NO: 30 and a N-terminal and/or C-terminal His-tag and/or HQ-tag such as SEQ ID NO: 33; or is a fragment thereof having arabinofuranosidase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of the mature polypeptide of SEQ ID NO: 29. In another embodiment, the polypeptide comprises or consists of the mature polypeptide of SEQ ID NO: 32. In another embodiment, the polypeptide comprises or consists of amino acids 1 to 438 of SEQ ID NO: 29. In another embodiment, the polypeptide comprises or consists of amino acids 1 to 438 of SEQ ID NO: 30. In another embodiment, the polypeptide comprises or consists of amino acids 1 to 446 of SEQ ID NO: 32. In another embodiment, the polypeptide comprises or consists of amino acids 1 to 446 of SEQ ID NO: 33. In an embodiment, the polypeptide has been isolated.

In a continuation of the fifth aspect, the invention relates to a polypeptide having arabinofuranosidase activity encoded by a polynucleotide that hybridizes under high stringency conditions or very high stringency conditions with (i) the mature polypeptide coding sequence of SEQ ID NO: 28 or (ii) the full-length complement of (i). In an embodiment, the polypeptide has been isolated.

In a continuation of the fifth aspect, the invention relates to a polypeptide having arabinofuranosidase activity encoded by a polynucleotide having a sequence identity to the mature polypeptide coding sequence of SEQ ID NO: 28 or the cDNA sequence thereof of at least 90%, e.g., at least 91%, at least 92%, at least 93%, at least 94%, at least 95%, at least 96%, at least 97%, at least 98%, at least 99%, or 100%. In a further embodiment, the polypeptide has been isolated.

In a continuation of the fifth aspect, the invention relates to variants of SEQ ID NO: 30 having arabinofuranosidase activity comprising one or more amino acid substitutions, and/or one or more amino acid deletions, and/or one or more amino acid insertions or any combination thereof at one or more (e.g., several) positions. In an embodiment, the number of positions comprising one or more amino acid substitutions, and/or one or more amino acid deletions, and/or one or more amino acid insertions or any combination thereof in SEQ ID NO: 30 is not more than 45, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44 or 45. In an embodiment, the number of positions comprising one or more amino acid substitutions, and/or one or more amino acid deletions, and/or one or more amino acid insertions or any combination thereof in SEQ ID NO: 30 is not more than 10, e.g., 1, 2, 3, 4, 5, 6, 7, 8, 9 or 10. In another embodiment, the number of substitutions, deletions, and/or insertions in SEQ ID NO: 30 is not more than 10, e.g., 1, 2, 3, 4, 5, 6, 7, 8, 9 or 10. In a further embodiment, the number of substitutions, preferably conservative substitutions, in SEQ ID NO: 30 is not more than 10, e.g., 1, 2, 3, 4, 5, 6, 7, 8, 9 or 10. In an embodiment, the variant has at least 60%, at least 70%, at least 75%, at least 80%, at least 85%, at least 90%, at least 95%, or at least 100% of the activity of the polypeptide of SEQ ID NO: 30. Examples of amino acid changes and conservative substitutions are described in the second aspect of the invention.

In an embodiment, the polypeptide of the fifth aspect comprises the motif [H/Y][L/M]F[F/S][A/C/H/S/T/V][A/D/G/N/R]D[D/E/N]G (SEQ ID NO: 1), preferably the motif [H/Y]LF[F/S][A/S/V][A/D/G]DNG (SEQ ID NO: 2), more preferable the motif YLFF[A/V][A/G]DNG (SEQ ID NO: 3), or even more preferably the motif YLFFAGDNG (SEQ ID NO: 4).

In a sixth aspect, the invention relates to polypeptides having arabinofuranosidase activity and having a sequence identity to the mature polypeptide of SEQ ID NO: 35 of at least 92%, e.g. at least 93%, at least 94%, at least 95%, at least 96%, at least 97%, at least 98%, at least 99%, which have arabinofuranosidase activity. In one embodiment, the polypeptides differ by up to 34 amino acids, e.g., between 1 and 34 amino acids, such as 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33 or 34 amino acids from the mature polypeptide of SEQ ID NO: 35.

In one embodiment, the polypeptides differ by up to 34 amino acids, e.g., between 1 and 34 amino acids, such as 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33 or 34 amino acids from SEQ ID NO: 36. In one embodiment, the polypeptides differ by up to 34 amino acids, e.g., between 1 and 34 amino acids, such as 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33 or 34 amino acids from SEQ ID NO: 39. In an embodiment, the polypeptide has at least 60%, at least 70%, at least 75%, at least 80%, at least 85%, at least 90%, at least 95%, or at least 100% of the activity of the polypeptide of SEQ ID NO: 36.

In one embodiment, the polypeptide preferably comprises or consists of the amino acid sequence of SEQ ID NO: 35 and/or SEQ ID NO: 36 or an allelic variant thereof; comprises the amino acid sequence of SEQ ID NO: 35 and/or SEQ ID NO: 36 and a N-terminal and/or C-terminal His-tag and/or HQ-tag such as SEQ ID NO: 39; or is a fragment thereof having arabinofuranosidase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of the mature polypeptide of SEQ ID NO: 35. In another embodiment, the polypeptide comprises or consists of the mature polypeptide of SEQ ID NO: 38. In another embodiment, the polypeptide comprises or consists of amino acids 1 to 438 of SEQ ID NO: 35. In another embodiment, the polypeptide comprises or consists of amino acids 1 to 438 of SEQ ID NO: 36. In another embodiment, the polypeptide comprises or consists of amino acids 1 to 446 of SEQ ID NO: 38. In another embodiment, the polypeptide comprises or consists of amino acids 1 to 446 of SEQ ID NO: 39. In an embodiment, the polypeptide has been isolated.

In a continuation of the sixth aspect, the invention relates to a polypeptide having arabinofuranosidase activity encoded by a polynucleotide that hybridizes under high stringency conditions or very high stringency conditions with (i) the mature polypeptide coding sequence of SEQ ID NO: 34 or (ii) the full-length complement of (i). In an embodiment, the polypeptide has been isolated.

In a continuation of the sixth aspect, the invention relates to a polypeptide having arabinofuranosidase activity encoded by a polynucleotide having a sequence identity to the mature polypeptide coding sequence of SEQ ID NO: 34 or the cDNA sequence thereof of at least 92%, e.g., at least 93%, at least 94%, at least 95%, at least 96%, at least 97%, at least 98%, at least 99%, or 100%. In a further embodiment, the polypeptide has been isolated.

In a continuation of the sixth aspect, the invention relates to variants of SEQ ID NO: 36 having arabinofuranosidase activity comprising one or more amino acid substitutions, and/or one or more amino acid deletions, and/or one or more amino acid insertions or any combination thereof at one or more (e.g., several) positions. In an embodiment, the number of positions comprising one or more amino acid substitutions, and/or one or more amino acid deletions, and/or one or more amino acid insertions or any combination thereof in SEQ ID NO: 36 is not more than 34, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33 or 34. In an embodiment, the number of positions comprising one or more amino acid substitutions, and/or one or more amino acid deletions, and/or one or more amino acid insertions or any combination thereof in SEQ ID NO: 36 is not more than 10, e.g., 1, 2, 3, 4, 5, 6, 7, 8, 9 or 10. In another embodiment, the number of substitutions, deletions, and/or insertions in SEQ ID NO: 36 is not more than 10, e.g., 1, 2, 3, 4, 5, 6, 7, 8, 9 or 10. In a further embodiment, the number of substitutions, preferably conservative substitutions, in SEQ ID NO: 36 is not more than 10, e.g., 1, 2, 3, 4, 5, 6, 7, 8, 9 or 10. In an embodiment, the variant has at least 60%, at least 70%, at least 75%, at least 80%, at least 85%, at least 90%, at least 95%, or at least 100% of the activity of the polypeptide of SEQ ID NO: 36. Examples of amino acid changes and conservative substitutions are described in the second aspect of the invention.

In an embodiment, the polypeptide of the sixth aspect comprises the motif [H/Y][L/M]F[F/S][A/C/H/S/T/V][A/D/G/N/R]D[D/E/N]G (SEQ ID NO: 1), preferably the motif [H/Y]LF[F/S][A/S/V][A/D/G]DNG (SEQ ID NO: 2), more preferable the motif YLFF[A/V][A/G]DNG (SEQ ID NO: 3), or even more preferably the motif YLFFAGDNG (SEQ ID NO: 4).

In a seventh aspect, the invention relates to polypeptides having arabinofuranosidase activity and having a sequence identity to the mature polypeptide of SEQ ID NO: 47 of at least 86%, e.g., at least 87%, at least 88%, at least 89%, at least 90%, at least 91%, at least 92%, at least 93%, at least 94%, at least 95%, at least 96%, at least 97%, at least 98%, at least 99%, which have arabinofuranosidase activity. In one embodiment, the polypeptides differ by up to 42 amino acids, e.g., between 1 and 42 amino acids, such as 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41 or 42 amino acids from the mature polypeptide of SEQ ID NO: 47.

In a continuation of the seventh aspect, the invention further relates to polypeptides having a sequence identity to SEQ ID NO: 48 of at least 86% which have arabinofuranosidase activity. In an embodiment, the polypeptide has a sequence identity to SEQ ID NO: 48 of at least 87%. In an embodiment, the polypeptide has a sequence identity to SEQ ID NO: 48 of at least 88%. In an embodiment, the polypeptide has a sequence identity to SEQ ID NO: 48 of at least 89%. In an embodiment, the polypeptide has a sequence identity to SEQ ID NO: 48 of at least 90%. In an embodiment, the polypeptide has a sequence identity to SEQ ID NO: 48 of at least 91%. In an embodiment, the polypeptide has a sequence identity to SEQ ID NO: 48 of at least 92%. In an embodiment, the polypeptide has a sequence identity to SEQ ID NO: 48 of at least 93%. In an embodiment, the polypeptide has a sequence identity to SEQ ID NO: 48 of at least 94%. In an embodiment, the polypeptide has a sequence identity to SEQ ID NO: 48 of at least 95%. In an embodiment, the polypeptide has a sequence identity to SEQ ID NO: 48 of at least 96%. In an embodiment, the polypeptide has a sequence identity to SEQ ID NO: 48 of at least 97%. In an embodiment, the polypeptide has a sequence identity to SEQ ID NO: 48 of at least 98%. In an embodiment, the polypeptide has a sequence identity to SEQ ID NO: 48 of at least 99%.

In one embodiment, the polypeptides differ by up to 42 amino acids, e.g., between 1 and 42 amino acids, such as 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41 or 42 amino acids from SEQ ID NO: 48. In one embodiment, the polypeptides differ by up to 42 amino acids, e.g., between 1 and 42 amino acids, such as 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41 or 42 amino acids from SEQ ID NO: 51. In an embodiment, the polypeptide has at least 60%, at least 70%, at least 75%, at least 80%, at least 85%, at least 90%, at least 95%, or at least 100% of the activity of the polypeptide of SEQ ID NO: 48.

In one embodiment, the polypeptide preferably comprises or consists of the amino acid sequence of SEQ ID NO: 47 and/or SEQ ID NO: 48 or an allelic variant thereof; comprises the amino acid sequence of SEQ ID NO: 47 and/or SEQ ID NO: 48 and a N-terminal and/or C-terminal His-tag and/or HQ-tag such as SEQ ID NO: 51; or is a fragment thereof having arabinofuranosidase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of the mature polypeptide of SEQ ID NO: 47. In another embodiment, the polypeptide comprises or consists of the mature polypeptide of SEQ ID NO: 50. In another embodiment, the polypeptide comprises or consists of amino acids 1 to 537 of SEQ ID NO: 47. In another embodiment, the polypeptide comprises or consists of amino acids 1 to 537 of SEQ ID NO: 48. In another embodiment, the polypeptide comprises or consists of amino acids 1 to 311 of SEQ ID NO: 50. In another embodiment, the polypeptide comprises or consists of amino acids 1 to 311 of SEQ ID NO: 51. In an embodiment, the polypeptide has been isolated.

In a continuation of the seventh aspect, the invention relates to a polypeptide having arabinofuranosidase activity encoded by a polynucleotide that hybridizes under high stringency conditions or very high stringency conditions with (i) the mature polypeptide coding sequence of SEQ ID NO: 46 or (ii) the full-length complement of (i). In an embodiment, the polypeptide has been isolated.

In a continuation of the seventh aspect, the invention relates to a polypeptide having arabinofuranosidase activity encoded by a polynucleotide having a sequence identity to the mature polypeptide coding sequence of SEQ ID NO: 46 or the cDNA sequence thereof of at least 86%, e.g. at least 87%, at least 88%, at least 89%, at least 90%, at least 91%, at least 92%, at least 93%, at least 94%, at least 95%, at least 96%, at least 97%, at least 98%, at least 99%, or 100%. In a further embodiment, the polypeptide has been isolated.

In a continuation of the seventh aspect, the invention relates to variants of SEQ ID NO: 48 having arabinofuranosidase activity comprising one or more amino acid substitutions, and/or one or more amino acid deletions, and/or one or more amino acid insertions or any combination thereof at one or more (e.g., several) positions. In an embodiment, the number of positions comprising one or more amino acid substitutions, and/or one or more amino acid deletions, and/or one or more amino acid insertions or any combination thereof in SEQ ID NO: 48 is not more than 42, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41 or 42. In an embodiment, the number of positions comprising one or more amino acid substitutions, and/or one or more amino acid deletions, and/or one or more amino acid insertions or any combination thereof in SEQ ID NO: 48 is not more than 10, e.g., 1, 2, 3, 4, 5, 6, 7, 8, 9 or 10. In another embodiment, the number of substitutions, deletions, and/or insertions in SEQ ID NO: 48 is not more than 10, e.g., 1, 2, 3, 4, 5, 6, 7, 8, 9 or 10. In a further embodiment, the number of substitutions, preferably conservative substitutions, in SEQ ID NO: 48 is not more than 10, e.g., 1, 2, 3, 4, 5, 6, 7, 8, 9 or 10. In an embodiment, the variant has at least 60%, at least 70%, at least 75%, at least 80%, at least 85%, at least 90%, at least 95%, or at least 100% of the activity of the polypeptide of SEQ ID NO: 48. Examples of amino acid changes and conservative substitutions are described in the second aspect of the invention.

In an embodiment, the polypeptide of the seventh aspect comprises the motif [H/Y][L/M]F[F/S][A/C/H/S/T/V][A/D/G/N/R]D[D/E/N]G (SEQ ID NO: 1), preferably the motif [H/Y]LF[F/S][A/S/V][A/D/G]DNG (SEQ ID NO: 2), more preferable the motif YLFF[A/V][A/G]DNG (SEQ ID NO: 3), or even more preferably the motif YLFFAGDNG (SEQ ID NO: 4).

In an eighth aspect, the invention relates to polypeptides having arabinofuranosidase activity and having a sequence identity to the mature polypeptide of SEQ ID NO: 53 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, which have arabinofuranosidase activity. In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 amino acids from the mature polypeptide of SEQ ID NO: 53.

In a continuation of the eighth aspect, the invention further relates to polypeptides having a sequence identity to SEQ ID NO: 54 of at least 80% which have arabinofuranosidase activity. In an embodiment, the polypeptide has a sequence identity to SEQ ID NO: 54 of at least 85%. In an embodiment, the polypeptide has a sequence identity to SEQ ID NO: 54 of at least 86%. In an embodiment, the polypeptide has a sequence identity to SEQ ID NO: 54 of at least 87%. In an embodiment, the polypeptide has a sequence identity to SEQ ID NO: 54 of at least 88%. In an embodiment, the polypeptide has a sequence identity to SEQ ID NO: 54 of at least 89%. In an embodiment, the polypeptide has a sequence identity to SEQ ID NO: 54 of at least 90%. In an embodiment, the polypeptide has a sequence identity to SEQ ID NO: 54 of at least 91%. In an embodiment, the polypeptide has a sequence identity to SEQ ID NO: 54 of at least 92%. In an embodiment, the polypeptide has a sequence identity to SEQ ID NO: 54 of at least 93%. In an embodiment, the polypeptide has a sequence identity to SEQ ID NO: 54 of at least 94%. In an embodiment, the polypeptide has a sequence identity to SEQ ID NO: 54 of at least 95%. In an embodiment, the polypeptide has a sequence identity to SEQ ID NO: 54 of at least 96%. In an embodiment, the polypeptide has a sequence identity to SEQ ID NO: 54 of at least 97%. In an embodiment, the polypeptide has a sequence identity to SEQ ID NO: 54 of at least 98%. In an embodiment, the polypeptide has a sequence identity to SEQ ID NO: 54 of at least 99%.

In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 amino acids from SEQ ID NO: 54. In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 amino acids from SEQ ID NO: 57. In an embodiment, the polypeptide has at least 60%, at least 70%, at least 75%, at least 80%, at least 85%, at least 90%, at least 95%, or at least 100% of the activity of the polypeptide of SEQ ID NO: 54.

In one embodiment, the polypeptide preferably comprises or consists of the amino acid sequence of SEQ ID NO: 53 and/or SEQ ID NO: 54 or an allelic variant thereof; comprises the amino acid sequence of SEQ ID NO: 53 and/or SEQ ID NO: 54 and a N-terminal and/or C-terminal His-tag and/or HQ-tag such as SEQ ID NO: 57; or is a fragment thereof having arabinofuranosidase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of the mature polypeptide of SEQ ID NO: 53. In another embodiment, the polypeptide comprises or consists of the mature polypeptide of SEQ ID NO: 56. In another embodiment, the polypeptide comprises or consists of amino acids 1 to 364 of SEQ ID NO: 53. In another embodiment, the polypeptide comprises or consists of amino acids 1 to 364 of SEQ ID NO: 54. In another embodiment, the polypeptide comprises or consists of amino acids 1 to 373 of SEQ ID NO: 56. In another embodiment, the polypeptide comprises or consists of amino acids 1 to 373 of SEQ ID NO: 57. In an embodiment, the polypeptide has been isolated.

In a continuation of the eighth aspect, the invention relates to a polypeptide having arabinofuranosidase activity encoded by a polynucleotide that hybridizes under high stringency conditions or very high stringency conditions with (i) the mature polypeptide coding sequence of SEQ ID NO: 52 or (ii) the full-length complement of (i). In an embodiment, the polypeptide has been isolated.

In a continuation of the eighth aspect, the invention relates to a polypeptide having arabinofuranosidase activity encoded by a polynucleotide having a sequence identity to the mature polypeptide coding sequence of SEQ ID NO: 52 or the cDNA sequence thereof of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. In a further embodiment, the polypeptide has been isolated.

In a continuation of the eighth aspect, the invention relates to variants of SEQ ID NO: 54 having arabinofuranosidase activity comprising one or more amino acid substitutions, and/or one or more amino acid deletions, and/or one or more amino acid insertions or any combination thereof at one or more (e.g., several) positions. In an embodiment, the number of positions comprising one or more amino acid substitutions, and/or one or more amino acid deletions, and/or one or more amino acid insertions or any combination thereof in SEQ ID NO: 54 is not more than 50, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50. In an embodiment, the number of positions comprising one or more amino acid substitutions, and/or one or more amino acid deletions, and/or one or more amino acid insertions or any combination thereof in SEQ ID NO: 54 is not more than 10, e.g., 1, 2, 3, 4, 5, 6, 7, 8, 9 or 10. In another embodiment, the number of substitutions, deletions, and/or insertions in SEQ ID NO: 54 is not more than 10, e.g., 1, 2, 3, 4, 5, 6, 7, 8, 9 or 10. In a further embodiment, the number of substitutions, preferably conservative substitutions, in SEQ ID NO: 54 is not more than 10, e.g., 1, 2, 3, 4, 5, 6, 7, 8, 9 or 10. In an embodiment, the variant has at least 60%, at least 70%, at least 75%, at least 80%, at least 85%, at least 90%, at least 95%, or at least 100% of the activity of the polypeptide of SEQ ID NO: 54. Examples of amino acid changes and conservative substitutions are described in the second aspect of the invention.

In an embodiment, the polypeptide of the eighth aspect comprises the motif [H/Y][L/M]F[F/S][A/C/H/S/T/V][A/D/G/N/R]D[D/E/N]G (SEQ ID NO: 1), preferably the motif [H/Y]LF[F/S][A/S/V][A/D/G]DNG (SEQ ID NO: 2), more preferable the motif YLFF[A/V][A/G]DNG (SEQ ID NO: 3), or even more preferably the motif YLFFAGDNG (SEQ ID NO: 4).

In an ninth aspect, the invention relates to polypeptides having arabinofuranosidase activity and having a sequence identity to the mature polypeptide of SEQ ID NO: 59 of at least 81%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, which have arabinofuranosidase activity. In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 amino acids from the mature polypeptide of SEQ ID NO: 59.

In a continuation of the ninth aspect, the invention further relates to polypeptides having a sequence identity to SEQ ID NO: 60 of at least 81% which have arabinofuranosidase activity. In an embodiment, the polypeptide has a sequence identity to SEQ ID NO: 60 of at least 86%. In an embodiment, the polypeptide has a sequence identity to SEQ ID NO: 60 of at least 87%. In an embodiment, the polypeptide has a sequence identity to SEQ ID NO: 60 of at least 88%. In an embodiment, the polypeptide has a sequence identity to SEQ ID NO: 60 of at least 89%. In an embodiment, the polypeptide has a sequence identity to SEQ ID NO: 60 of at least 90%. In an embodiment, the polypeptide has a sequence identity to SEQ ID NO: 60 of at least 91%. In an embodiment, the polypeptide has a sequence identity to SEQ ID NO: 60 of at least 92%. In an embodiment, the polypeptide has a sequence identity to SEQ ID NO: 60 of at least 93%. In an embodiment, the polypeptide has a sequence identity to SEQ ID NO: 60 of at least 94%. In an embodiment, the polypeptide has a sequence identity to SEQ ID NO: 60 of at least 95%. In an embodiment, the polypeptide has a sequence identity to SEQ ID NO: 60 of at least 96%. In an embodiment, the polypeptide has a sequence identity to SEQ ID NO: 60 of at least 97%. In an embodiment, the polypeptide has a sequence identity to SEQ ID NO: 60 of at least 98%. In an embodiment, the polypeptide has a sequence identity to SEQ ID NO: 60 of at least 99%.

In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 amino acids from SEQ ID NO: 60. In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 amino acids from SEQ ID NO: 63. In an embodiment, the polypeptide has at least 60%, at least 70%, at least 75%, at least 80%, at least 85%, at least 90%, at least 95%, or at least 100% of the activity of the polypeptide of SEQ ID NO: 60.

In one embodiment, the polypeptide preferably comprises or consists of the amino acid sequence of SEQ ID NO: 59 and/or SEQ ID NO: 60 or an allelic variant thereof; comprises the amino acid sequence of SEQ ID NO: 59 and/or SEQ ID NO: 60 and a N-terminal and/or C-terminal His-tag and/or HQ-tag; or is a fragment thereof having arabinofuranosidase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of the mature polypeptide of SEQ ID NO: 59. In another embodiment, the polypeptide comprises or consists of the mature polypeptide of SEQ ID NO: 62. In another embodiment, the polypeptide comprises or consists of amino acids 1 to 436 of SEQ ID NO: 59. In another embodiment, the polypeptide comprises or consists of amino acids 1 to 436 of SEQ ID NO: 60. In another embodiment, the polypeptide comprises or consists of amino acids 1 to 444 of SEQ ID NO: 62. In another embodiment, the polypeptide comprises or consists of amino acids 1 to 444 of SEQ ID NO: 63. In an embodiment, the polypeptide has been isolated.

In a continuation of the ninth aspect, the invention relates to a polypeptide having arabinofuranosidase activity encoded by a polynucleotide that hybridizes under high stringency conditions or very high stringency conditions with (i) the mature polypeptide coding sequence of SEQ ID NO: 58 or (ii) the full-length complement of (i). In an embodiment, the polypeptide has been isolated.

In a continuation of the ninth aspect, the invention relates to a polypeptide having arabinofuranosidase activity encoded by a polynucleotide having a sequence identity to the mature polypeptide coding sequence of SEQ ID NO: 58 or the cDNA sequence thereof of at least 81%, e.g. at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. In a further embodiment, the polypeptide has been isolated.

In a continuation of the ninth aspect, the invention relates to variants of SEQ ID NO: 60 having arabinofuranosidase activity comprising, deletion, and/or insertion at one or more (e.g., several) positions. In an embodiment, the number of positions comprising one or more amino acid substitutions, and/or one or more amino acid deletions, and/or one or more amino acid insertions or any combination thereof in SEQ ID NO: 60 is not more than 50, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50. In an embodiment, the number of positions comprising one or more amino acid substitutions, and/or one or more amino acid deletions, and/or one or more amino acid insertions or any combination thereof in SEQ ID NO: 60 is not more than 10, e.g., 1, 2, 3, 4, 5, 6, 7, 8, 9 or 10. In another embodiment, the number of substitutions, deletions, and/or insertions in SEQ ID NO: 60 is not more than 10, e.g., 1, 2, 3, 4, 5, 6, 7, 8, 9 or 10. In a further embodiment, the number of substitutions, preferably conservative substitutions, in SEQ ID NO: 60 is not more than 10, e.g., 1, 2, 3, 4, 5, 6, 7, 8, 9 or 10. In an variant, the polypeptide has at least 60%, at least 70%, at least 75%, at least 80%, at least 85%, at least 90%, at least 95%, or at least 100% of the activity of the polypeptide of SEQ ID NO: 60. Examples of amino acid changes and conservative substitutions are described in the second aspect of the invention.

In an embodiment, the polypeptide of the ninth aspect comprises the motif [H/Y][L/M]F[F/S][A/C/H/S/T/V][A/D/G/N/R]D[D/E/N]G (SEQ ID NO: 1), preferably the motif [H/Y]LF[F/S][A/S/V][A/D/G]DNG (SEQ ID NO: 2), more preferable the motif YLFF[A/V][A/G]DNG (SEQ ID NO: 3), or even more preferably the motif YLFFAGDNG (SEQ ID NO: 4).

In a tenth aspect, the invention relates to polypeptides having arabinofuranosidase activity and having a sequence identity to the mature polypeptide of SEQ ID NO: 65 of at least 84%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, which have arabinofuranosidase activity. In one embodiment, the polypeptides differ by up to 48 amino acids, e.g., between 1 and 48 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47 or 48 amino acids from the mature polypeptide of SEQ ID NO: 65.

In a continuation of the tenth aspect, the invention further relates to polypeptides having a sequence identity to SEQ ID NO: 66 of at least 84% which have arabinofuranosidase activity. In an embodiment, the polypeptide has a sequence identity to SEQ ID NO: 66 of at least 86%. In an embodiment, the polypeptide has a sequence identity to SEQ ID NO: 66 of at least 87%. In an embodiment, the polypeptide has a sequence identity to SEQ ID NO: 66 of at least 88%. In an embodiment, the polypeptide has a sequence identity to SEQ ID NO: 66 of at least 89%. In an embodiment, the polypeptide has a sequence identity to SEQ ID NO: 66 of at least 90%. In an embodiment, the polypeptide has a sequence identity to SEQ ID NO: 66 of at least 91%. In an embodiment, the polypeptide has a sequence identity to SEQ ID NO: 66 of at least 92%. In an embodiment, the polypeptide has a sequence identity to SEQ ID NO: 66 of at least 93%. In an embodiment, the polypeptide has a sequence identity to SEQ ID NO: 66 of at least 94%. In an embodiment, the polypeptide has a sequence identity to SEQ ID NO: 66 of at least 95%. In an embodiment, the polypeptide has a sequence identity to SEQ ID NO: 66 of at least 96%. In an embodiment, the polypeptide has a sequence identity to SEQ ID NO: 66 of at least 97%. In an embodiment, the polypeptide has a sequence identity to SEQ ID NO: 66 of at least 98%. In an embodiment, the polypeptide has a sequence identity to SEQ ID NO: 66 of at least 99%.

In one embodiment, the polypeptides differ by up to 48 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47 or 48 amino acids from SEQ ID NO: 66. In one embodiment, the polypeptides differ by up to 48 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47 or 48 amino acids from SEQ ID NO: 69. In an embodiment, the polypeptide has at least 60%, at least 70%, at least 75%, at least 80%, at least 85%, at least 90%, at least 95%, or at least 100% of the activity of the polypeptide of SEQ ID NO: 66.

In one embodiment, the polypeptide preferably comprises or consists of the amino acid sequence of SEQ ID NO: 65 and/or SEQ ID NO: 66 or an allelic variant thereof; comprises the amino acid sequence of SEQ ID NO: 65 and/or SEQ ID NO: 66 and a N-terminal and/or C-terminal His-tag and/or HQ-tag such as SEQ ID NO: 69; or is a fragment thereof having arabinofuranosidase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of the mature polypeptide of SEQ ID NO: 65. In another embodiment, the polypeptide comprises or consists of the mature polypeptide of SEQ ID NO: 68. In another embodiment, the polypeptide comprises or consists of amino acids 1 to 311 of SEQ ID NO: 65. In another embodiment, the polypeptide comprises or consists of amino acids 1 to 311 of SEQ ID NO: 66. In another embodiment, the polypeptide comprises or consists of amino acids 1 to 311 of SEQ ID NO: 68. In another embodiment, the polypeptide comprises or consists of amino acids 1 to 311 of SEQ ID NO: 69. In an embodiment, the polypeptide has been isolated.

In a continuation of the tenth aspect, the invention relates to a polypeptide having arabinofuranosidase activity encoded by a polynucleotide that hybridizes under high stringency conditions or very high stringency conditions with (i) the mature polypeptide coding sequence of SEQ ID NO: 64 or (ii) the full-length complement of (i). In an embodiment, the polypeptide has been isolated.

In a continuation of the tenth aspect, the invention relates to a polypeptide having arabinofuranosidase activity encoded by a polynucleotide having a sequence identity to the mature polypeptide coding sequence of SEQ ID NO: 64 or the cDNA sequence thereof of at least 84%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. In a further embodiment, the polypeptide has been isolated.

In a continuation of the tenth aspect, the invention relates to variants of SEQ ID NO: 66 having arabinofuranosidase activity comprising one or more amino acid substitutions, and/or one or more amino acid deletions, and/or one or more amino acid insertions or any combination thereof at one or more (e.g., several) positions. In an embodiment, the number of positions comprising one or more amino acid substitutions, and/or one or more amino acid deletions, and/or one or more amino acid insertions or any combination thereof in SEQ ID NO: 66 is not more than 48, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47 or 48. In an embodiment, the number of positions comprising one or more amino acid substitutions, and/or one or more amino acid deletions, and/or one or more amino acid insertions or any combination thereof in SEQ ID NO: 66 is not more than 10, e.g., 1, 2, 3, 4, 5, 6, 7, 8, 9 or 10. In another embodiment, the number of substitutions, deletions, and/or insertions in SEQ ID NO: 66 is not more than 10, e.g., 1, 2, 3, 4, 5, 6, 7, 8, 9 or 10. In a further embodiment, the number of substitutions, preferably conservative substitutions, in SEQ ID NO: 66 is not more than 10, e.g., 1, 2, 3, 4, 5, 6, 7, 8, 9 or 10. In an embodiment, the variant has at least 60%, at least 70%, at least 75%, at least 80%, at least 85%, at least 90%, at least 95%, or at least 100% of the activity of the polypeptide of SEQ ID NO: 66. Examples of amino acid changes and conservative substitutions are described in the second aspect of the invention.

In an embodiment, the polypeptide of the tenth aspect comprises the motif [H/Y][L/M]F[F/S][A/C/H/S/T/V][A/D/G/N/R]D[D/E/N]G (SEQ ID NO: 1), preferably the motif [H/Y]LF[F/S][A/S/V][A/D/G]DNG (SEQ ID NO: 2), more preferable the motif YLFF[A/V][A/G]DNG (SEQ ID NO: 3), or even more preferably the motif YLFFAGDNG (SEQ ID NO: 4).

In an eleventh aspect, the invention relates to polypeptides having arabinofuranosidase activity and having a sequence identity to the mature polypeptide of SEQ ID NO: 104 of at least 87%, e.g., at least 88%, at least 89%, at least 90%, at least 91%, at least 92%, at least 93%, at least 94%, at least 95%, at least 96%, at least 97%, at least 98%, at least 99%, which have arabinofuranosidase activity. In one embodiment, the polypeptides differ by up to 39 amino acids, e.g., between 1 and 39 amino acids, such as 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38 or 39 amino acids from the mature polypeptide of SEQ ID NO: 104.

In a continuation of the eleventh aspect, the invention further relates to polypeptides having a sequence identity to SEQ ID NO: 105 of at least 87% which have arabinofuranosidase activity. In an embodiment, the polypeptide has a sequence identity to SEQ ID NO: 105 of at least 88%. In an embodiment, the polypeptide has a sequence identity to SEQ ID NO: 105 of at least 89%. In an embodiment, the polypeptide has a sequence identity to SEQ ID NO: 105 of at least 90%. In an embodiment, the polypeptide has a sequence identity to SEQ ID NO: 105 of at least 91%. In an embodiment, the polypeptide has a sequence identity to SEQ ID NO: 105 of at least 92%. In an embodiment, the polypeptide has a sequence identity to SEQ ID NO: 105 of at least 93%. In an embodiment, the polypeptide has a sequence identity to SEQ ID NO: 105 of at least 94%. In an embodiment, the polypeptide has a sequence identity to SEQ ID NO: 105 of at least 95%. In an embodiment, the polypeptide has a sequence identity to SEQ ID NO: 105 of at least 96%. In an embodiment, the polypeptide has a sequence identity to SEQ ID NO: 105 of at least 97%. In an embodiment, the polypeptide has a sequence identity to SEQ ID NO: 105 of at least 98%. In an embodiment, the polypeptide has a sequence identity to SEQ ID NO: 105 of at least 99%.

In one embodiment, the polypeptides differ by up to 39 amino acids, e.g., between 1 and 39 amino acids, such as 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38 or 39 amino acids from SEQ ID NO: 105. In an embodiment, the polypeptide has at least 60%, at least 70%, at least 75%, at least 80%, at least 85%, at least 90%, at least 95%, or at least 100% of the activity of the polypeptide of SEQ ID NO: 105.

In one embodiment, the polypeptide preferably comprises or consists of the amino acid sequence of SEQ ID NO: 104 and/or SEQ ID NO: 105 or an allelic variant thereof; comprises the amino acid sequence of SEQ ID NO: 104 and/or SEQ ID NO: 105 and a N-terminal and/or C-terminal His-tag and/or HQ-tag; or is a fragment thereof having arabinofuranosidase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of the mature polypeptide of SEQ ID NO: 105. In another embodiment, the polypeptide comprises or consists of amino acids 1 to 302 of SEQ ID NO: 104. In another embodiment, the polypeptide comprises or consists of amino acids 1 to 302 of SEQ ID NO: 105. In an embodiment, the polypeptide has been isolated.

In a continuation of the eleventh aspect, the invention relates to a polypeptide having arabinofuranosidase activity encoded by a polynucleotide that hybridizes under very high stringency conditions with (i) the mature polypeptide coding sequence of SEQ ID NO: 103 or (ii) the full-length complement of (i). In an embodiment, the polypeptide has been isolated.

In a continuation of the eleventh aspect, the invention relates to a polypeptide having arabinofuranosidase activity encoded by a polynucleotide having a sequence identity to the mature polypeptide coding sequence of SEQ ID NO: 103 or the cDNA sequence thereof of at least 87%, e.g., at least 88%, at least 89%, at least 90%, at least 91%, at least 92%, at least 93%, at least 94%, at least 95%, at least 96%, at least 97%, at least 98%, at least 99%, or 100%. In a further embodiment, the polypeptide has been isolated.

In a continuation of the eleventh aspect, the invention relates to variants of SEQ ID NO: 105 having arabinofuranosidase activity comprising one or more amino acid substitutions, and/or one or more amino acid deletions, and/or one or more amino acid insertions or any combination thereof at one or more (e.g., several) positions. In an embodiment, the number of positions comprising one or more amino acid substitutions, and/or one or more amino acid deletions, and/or one or more amino acid insertions or any combination thereof in SEQ ID NO: 105 is not more than 39, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38 or 39. In an embodiment, the number of positions comprising one or more amino acid substitutions, and/or one or more amino acid deletions, and/or one or more amino acid insertions or any combination thereof in SEQ ID NO: 105 is not more than 10, e.g., 1, 2, 3, 4, 5, 6, 7, 8, 9 or 10. In another embodiment, the number of substitutions, deletions, and/or insertions in SEQ ID NO: 105 is not more than 10, e.g., 1, 2, 3, 4, 5, 6, 7, 8, 9 or 10. In a further embodiment, the number of substitutions, preferably conservative substitutions, in SEQ ID NO: 105 is not more than 10, e.g., 1, 2, 3, 4, 5, 6, 7, 8, 9 or 10. In an embodiment, the variant has at least 60%, at least 70%, at least 75%, at least 80%, at least 85%, at least 90%, at least 95%, or at least 100% of the activity of the polypeptide of SEQ ID NO: 105. Examples of amino acid changes and conservative substitutions are described in the second aspect of the invention.

In an embodiment, the polypeptide of the eleventh aspect comprises the motif [H/Y][L/M]F[F/S][A/C/H/S/T/V][A/D/G/N/R]D[D/E/N]G (SEQ ID NO: 1), preferably the motif [H/Y]LF[F/S][A/S/V][A/D/G]DNG (SEQ ID NO: 2), more preferable the motif YLFF[A/V][A/G]DNG (SEQ ID NO: 3), or even more preferably the motif YLFFAGDNG (SEQ ID NO: 4).

In an twelfth aspect, the invention relates to polypeptides having arabinofuranosidase activity and having a sequence identity to the mature polypeptide of SEQ ID NO: 107 of at least 85%, e.g., at least 90%, at least 91%, at least 92%, at least 93%, at least 94%, at least 95%, at least 96%, at least 97%, at least 98%, at least 99%, which have arabinofuranosidase activity. In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 amino acids from the mature polypeptide of SEQ ID NO: 107.

In a continuation of the twelfth aspect, the invention further relates to polypeptides having a sequence identity to SEQ ID NO: 108 of at least 85% which have arabinofuranosidase activity. In an embodiment, the polypeptide has a sequence identity to SEQ ID NO: 108 of at least 86%. In an embodiment, the polypeptide has a sequence identity to SEQ ID NO: 108 of at least 87%. In an embodiment, the polypeptide has a sequence identity to SEQ ID NO: 108 of at least 88%. In an embodiment, the polypeptide has a sequence identity to SEQ ID NO: 108 of at least 89%. In an embodiment, the polypeptide has a sequence identity to SEQ ID NO: 108 of at least 90%. In an embodiment, the polypeptide has a sequence identity to SEQ ID NO: 108 of at least 91%. In an embodiment, the polypeptide has a sequence identity to SEQ ID NO: 108 of at least 92%. In an embodiment, the polypeptide has a sequence identity to SEQ ID NO: 108 of at least 93%. In an embodiment, the polypeptide has a sequence identity to SEQ ID NO: 108 of at least 94%. In an embodiment, the polypeptide has a sequence identity to SEQ ID NO: 108 of at least 95%. In an embodiment, the polypeptide has a sequence identity to SEQ ID NO: 108 of at least 96%. In an embodiment, the polypeptide has a sequence identity to SEQ ID NO: 108 of at least 97%. In an embodiment, the polypeptide has a sequence identity to SEQ ID NO: 108 of at least 98%. In an embodiment, the polypeptide has a sequence identity to SEQ ID NO: 108 of at least 99%.

In one embodiment, the polypeptides differ by up to 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 amino acids from SEQ ID NO: 108. In one embodiment, the polypeptides differ by up to 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 amino acids from SEQ ID NO: 111. In an embodiment, the polypeptide has at least 60%, at least 70%, at least 75%, at least 80%, at least 85%, at least 90%, at least 95%, or at least 100% of the activity of the polypeptide of SEQ ID NO: 108.

In one embodiment, the polypeptide preferably comprises or consists of the amino acid sequence of SEQ ID NO: 107 and/or SEQ ID NO: 108 or an allelic variant thereof; comprises the amino acid sequence of SEQ ID NO: 107 and/or SEQ ID NO: 108 and a N-terminal and/or C-terminal His-tag and/or HQ-tag such as SEQ ID NO: 111; or is a fragment thereof having arabinofuranosidase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of the mature polypeptide of SEQ ID NO: 107. In another embodiment, the polypeptide comprises or consists of the mature polypeptide of SEQ ID NO: 110. In another embodiment, the polypeptide comprises or consists of amino acids 1 to 464 of SEQ ID NO: 107. In another embodiment, the polypeptide comprises or consists of amino acids 1 to 464 of SEQ ID NO: 108. In another embodiment, the polypeptide comprises or consists of amino acids 1 to 472 of SEQ ID NO: 110. In another embodiment, the polypeptide comprises or consists of amino acids 1 to 472 of SEQ ID NO: 111. In an embodiment, the polypeptide has been isolated.

In a continuation of the twelfth aspect, the invention relates to a polypeptide having arabinofuranosidase activity encoded by a polynucleotide that hybridizes under high stringency conditions or very high stringency conditions with (i) the mature polypeptide coding sequence of SEQ ID NO: 106 or (ii) the full-length complement of (i). In an embodiment, the polypeptide has been isolated.

In a continuation of the twelfth aspect, the invention relates to a polypeptide having arabinofuranosidase activity encoded by a polynucleotide having a sequence identity to the mature polypeptide coding sequence of SEQ ID NO: 106 or the cDNA sequence thereof of at least 85%, e.g., at least 90%, at least 91%, at least 92%, at least 93%, at least 94%, at least 95%, at least 96%, at least 97%, at least 98%, at least 99%, or 100%. In a further embodiment, the polypeptide has been isolated.

In a continuation of the twelfth aspect, the invention relates to variants of SEQ ID NO:

108 having arabinofuranosidase activity comprising one or more amino acid substitutions, and/or one or more amino acid deletions, and/or one or more amino acid insertions or any combination thereof at one or more (e.g., several) positions. In an embodiment, the number of positions comprising one or more amino acid substitutions, and/or one or more amino acid deletions, and/or one or more amino acid insertions or any combination thereof in SEQ ID NO: 108 is not more than 50, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50. In an embodiment, the number of positions comprising one or more amino acid substitutions, and/or one or more amino acid deletions, and/or one or more amino acid insertions or any combination thereof in SEQ ID NO: 108 is not more than 10, e.g., 1, 2, 3, 4, 5, 6, 7, 8, 9 or 10. In another embodiment, the number of substitutions, deletions, and/or insertions in SEQ ID NO: 108 is not more than 10, e.g., 1, 2, 3, 4, 5, 6, 7, 8, 9 or 10. In a further embodiment, the number of substitutions, preferably conservative substitutions, in SEQ ID NO: 108 is not more than 10, e.g., 1, 2, 3, 4, 5, 6, 7, 8, 9 or 10. In an embodiment, the variant has at least 60%, at least 70%, at least 75%, at least 80%, at least 85%, at least 90%, at least 95%, or at least 100% of the activity of the polypeptide of SEQ ID NO: 108. Examples of amino acid changes and conservative substitutions are described in the second aspect of the invention.

In an embodiment, the polypeptide of the twelfth aspect comprises the motif [H/Y][L/M]F[F/S][A/C/H/S/T/V][A/D/G/N/R]D[D/E/N]G (SEQ ID NO: 1), preferably the motif [H/Y]LF[F/S][A/S/V][A/D/G]DNG (SEQ ID NO: 2), more preferable the motif YLFF[A/V][A/G]DNG (SEQ ID NO: 3), or even more preferably the motif YLFFAGDNG (SEQ ID NO: 4).

In a thirteenth aspect, the invention relates to polypeptides having arabinofuranosidase activity and having a sequence identity to the mature polypeptide of SEQ ID NO: 113 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, which have arabinofuranosidase activity. In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 amino acids from the mature polypeptide of SEQ ID NO: 113.

In a continuation of the thirteenth aspect, the invention further relates to polypeptides having a sequence identity to SEQ ID NO: 114 of at least 80% which have arabinofuranosidase activity. In an embodiment, the polypeptide has a sequence identity to SEQ ID NO: 114 of at least 85%. In an embodiment, the polypeptide has a sequence identity to SEQ ID NO: 114 of at least 86%. In an embodiment, the polypeptide has a sequence identity to SEQ ID NO: 114 of at least 87%. In an embodiment, the polypeptide has a sequence identity to SEQ ID NO: 114 of at least 88%. In an embodiment, the polypeptide has a sequence identity to SEQ ID NO: 114 of at least 89%. In an embodiment, the polypeptide has a sequence identity to SEQ ID NO: 114 of at least 90%. In an embodiment, the polypeptide has a sequence identity to SEQ ID NO: 114 of at least 91%. In an embodiment, the polypeptide has a sequence identity to SEQ ID NO: 114 of at least 92%. In an embodiment, the polypeptide has a sequence identity to SEQ ID NO: 114 of at least 93%. In an embodiment, the polypeptide has a sequence identity to SEQ ID NO: 114 of at least 94%. In an embodiment, the polypeptide has a sequence identity to SEQ ID NO: 114 of at least 95%. In an embodiment, the polypeptide has a sequence identity to SEQ ID NO: 114 of at least 96%. In an embodiment, the polypeptide has a sequence identity to SEQ ID NO: 114 of at least 97%. In an embodiment, the polypeptide has a sequence identity to SEQ ID NO: 114 of at least 98%. In an embodiment, the polypeptide has a sequence identity to SEQ ID NO: 114 of at least 99%.

In one embodiment, the polypeptides differ by up to 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 amino acids from SEQ ID NO: 114. In one embodiment, the polypeptides differ by up to 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 amino acids from SEQ ID NO: 117. In an embodiment, the polypeptide has at least 60%, at least 70%, at least 75%, at least 80%, at least 85%, at least 90%, at least 95%, or at least 100% of the activity of the polypeptide of SEQ ID NO: 114.

In one embodiment, the polypeptide preferably comprises or consists of the amino acid sequence of SEQ ID NO: 113 and/or SEQ ID NO: 114 or an allelic variant thereof; comprises the amino acid sequence of SEQ ID NO: 113 and/or SEQ ID NO: 114 and a N-terminal and/or C-terminal His-tag and/or HQ-tag such as SEQ ID NO: 117; or is a fragment thereof having arabinofuranosidase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of the mature polypeptide of SEQ ID NO: 113. In another embodiment, the polypeptide comprises or consists of the mature polypeptide of SEQ ID NO: 116. In another embodiment, the polypeptide comprises or consists of amino acids 1 to 364 of SEQ ID NO: 113. In another embodiment, the polypeptide comprises or consists of amino acids 1 to 364 of SEQ ID NO: 114. In another embodiment, the polypeptide comprises or consists of amino acids 1 to 372 of SEQ ID NO: 116. In another embodiment, the polypeptide comprises or consists of amino acids 1 to 372 of SEQ ID NO: 117. In an embodiment, the polypeptide has been isolated.

In a continuation of the thirteenth aspect, the invention relates to a polypeptide having arabinofuranosidase activity encoded by a polynucleotide that hybridizes under high stringency conditions or very high stringency conditions with (i) the mature polypeptide coding sequence of SEQ ID NO: 112 or (ii) the full-length complement of (i). In an embodiment, the polypeptide has been isolated.

In a continuation of the thirteenth aspect, the invention relates to a polypeptide having arabinofuranosidase activity encoded by a polynucleotide having a sequence identity to the mature polypeptide coding sequence of SEQ ID NO: 112 or the cDNA sequence thereof of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. In a further embodiment, the polypeptide has been isolated.

In a continuation of the thirteenth aspect, the invention relates to variants of SEQ ID NO: 114 having arabinofuranosidase activity comprising one or more amino acid substitutions, and/or one or more amino acid deletions, and/or one or more amino acid insertions or any combination thereof at one or more (e.g., several) positions. In an embodiment, the number of positions comprising one or more amino acid substitutions, and/or one or more amino acid deletions, and/or one or more amino acid insertions or any combination thereof in SEQ ID NO: 114 is not more than 50, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50. In an embodiment, the number of positions comprising one or more amino acid substitutions, and/or one or more amino acid deletions, and/or one or more amino acid insertions or any combination thereof in SEQ ID NO: 114 is not more than 10, e.g., 1, 2, 3, 4, 5, 6, 7, 8, 9 or 10. In another embodiment, the number of substitutions, deletions, and/or insertions in SEQ ID NO: 114 is not more than 10, e.g., 1, 2, 3, 4, 5, 6, 7, 8, 9 or 10. In a further embodiment, the number of substitutions, preferably conservative substitutions, in SEQ ID NO: 114 is not more than 10, e.g., 1, 2, 3, 4, 5, 6, 7, 8, 9 or 10. In an embodiment, the variant has at least 60%, at least 70%, at least 75%, at least 80%, at least 85%, at least 90%, at least 95%, or at least 100% of the activity of the polypeptide of SEQ ID NO: 114. Examples of amino acid changes and conservative substitutions are described in the second aspect of the invention.

In an embodiment, the polypeptide of the thirteenth aspect comprises the motif [H/Y][L/M]F[F/S][A/C/H/S/T/V][A/D/G/N/R]D[D/E/N]G (SEQ ID NO: 1), preferably the motif [H/Y]LF[F/S][A/S/V][A/D/G]DNG (SEQ ID NO: 2), more preferable the motif YLFF[A/V][A/G]DNG (SEQ ID NO: 3), or even more preferably the motif YLFFAGDNG (SEQ ID NO: 4).

In a fourteenth aspect, the invention relates to polypeptides having arabinofuranosidase activity and having a sequence identity to the mature polypeptide of SEQ ID NO: 119 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, which have arabinofuranosidase activity. In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 amino acids from the mature polypeptide of SEQ ID NO: 119.

In a continuation of the fourteenth aspect, the invention further relates to polypeptides having a sequence identity to SEQ ID NO: 120 of at least 80% which have arabinofuranosidase activity. In an embodiment, the polypeptide has a sequence identity to SEQ ID NO: 120 of at least 85%. In an embodiment, the polypeptide has a sequence identity to SEQ ID NO: 120 of at least 86%. In an embodiment, the polypeptide has a sequence identity to SEQ ID NO: 120 of at least 87%. In an embodiment, the polypeptide has a sequence identity to SEQ ID NO: 120 of at least 88%. In an embodiment, the polypeptide has a sequence identity to SEQ ID NO: 120 of at least 89%. In an embodiment, the polypeptide has a sequence identity to SEQ ID NO: 120 of at least 90%. In an embodiment, the polypeptide has a sequence identity to SEQ ID NO: 120 of at least 91%. In an embodiment, the polypeptide has a sequence identity to SEQ ID NO: 120 of at least 92%. In an embodiment, the polypeptide has a sequence identity to SEQ ID NO: 120 of at least 93%. In an embodiment, the polypeptide has a sequence identity to SEQ ID NO: 120 of at least 94%. In an embodiment, the polypeptide has a sequence identity to SEQ ID NO: 120 of at least 95%. In an embodiment, the polypeptide has a sequence identity to SEQ ID NO: 120 of at least 96%. In an embodiment, the polypeptide has a sequence identity to SEQ ID NO: 120 of at least 97%. In an embodiment, the polypeptide has a sequence identity to SEQ ID NO: 120 of at least 98%. In an embodiment, the polypeptide has a sequence identity to SEQ ID NO: 120 of at least 99%.

In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 amino acids from SEQ ID NO: 120. In an embodiment, the polypeptide has at least 60%, at least 70%, at least 75%, at least 80%, at least 85%, at least 90%, at least 95%, or at least 100% of the activity of the polypeptide of SEQ ID NO: 120.

In one embodiment, the polypeptide preferably comprises or consists of the amino acid sequence of SEQ ID NO: 119 and/or SEQ ID NO: 120 or an allelic variant thereof; comprises the amino acid sequence of SEQ ID NO: 119 and/or SEQ ID NO: 120 and a N-terminal and/or C-terminal His-tag and/or HQ-tag; or is a fragment thereof having arabinofuranosidase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of the mature polypeptide of SEQ ID NO: 120. In another embodiment, the polypeptide comprises or consists of amino acids 1 to 357 of SEQ ID NO: 119. In another embodiment, the polypeptide comprises or consists of amino acids 1 to 357 of SEQ ID NO: 120. In an embodiment, the polypeptide has been isolated.

In a continuation of the fourteenth aspect, the invention relates to a polypeptide having arabinofuranosidase activity encoded by a polynucleotide that hybridizes under high stringency conditions or very high stringency conditions with (i) the mature polypeptide coding sequence of SEQ ID NO: 118 or (ii) the full-length complement of (i). In an embodiment, the polypeptide has been isolated.

In a continuation of the fourteenth aspect, the invention relates to a polypeptide having arabinofuranosidase activity encoded by a polynucleotide having a sequence identity to the mature polypeptide coding sequence of SEQ ID NO: 118 or the cDNA sequence thereof of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. In a further embodiment, the polypeptide has been isolated.

In a continuation of the fourteenth aspect, the invention relates to variants of SEQ ID NO: 120 having arabinofuranosidase activity comprising one or more amino acid substitutions, and/or one or more amino acid deletions, and/or one or more amino acid insertions or any combination thereof at one or more (e.g., several) positions. In an embodiment, the number of positions comprising one or more amino acid substitutions, and/or one or more amino acid deletions, and/or one or more amino acid insertions or any combination thereof in SEQ ID NO: 120 is not more than 50, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50. In an embodiment, the number of positions comprising one or more amino acid substitutions, and/or one or more amino acid deletions, and/or one or more amino acid insertions or any combination thereof in SEQ ID NO: 120 is not more than 10, e.g., 1, 2, 3, 4, 5, 6, 7, 8, 9 or 10. In another embodiment, the number of substitutions, deletions, and/or insertions in SEQ ID NO: 120 is not more than 10, e.g., 1, 2, 3, 4, 5, 6, 7, 8, 9 or 10. In a further embodiment, the number of substitutions, preferably conservative substitutions, in SEQ ID NO: 120 is not more than 10, e.g., 1, 2, 3, 4, 5, 6, 7, 8, 9 or 10. In an embodiment, the variant has at least 60%, at least 70%, at least 75%, at least 80%, at least 85%, at least 90%, at least 95%, or at least 100% of the activity of the polypeptide of SEQ ID NO: 120. Examples of amino acid changes and conservative substitutions are described in the second aspect of the invention.

In an embodiment, the polypeptide of the fourteenth aspect comprises the motif [H/Y][L/M]F[F/S][A/C/H/S/T/V][A/D/G/N/R]D[D/E/N]G (SEQ ID NO: 1), preferably the motif [H/Y]LF[F/S][A/S/V][A/D/G]DNG (SEQ ID NO: 2), more preferable the motif YLFF[A/V][A/G]DNG (SEQ ID NO: 3), or even more preferably the motif YLFFAGDNG (SEQ ID NO: 4).

In a fifteenth aspect, the invention relates to polypeptides having arabinofuranosidase activity and having a sequence identity to the mature polypeptide of SEQ ID NO: 122 of at least 89%, e.g., at least 90%, at least 91%, at least 92%, at least 93%, at least 94%, at least 95%, at least 96%, at least 97%, at least 98%, at least 99%, which have arabinofuranosidase activity. In one embodiment, the polypeptides differ by up to 33 amino acids, e.g., between 1 and 33 amino acids, such as 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32 or 33 amino acids from the mature polypeptide of SEQ ID NO: 122.

In a continuation of the fifteenth aspect, the invention further relates to polypeptides having a sequence identity to SEQ ID NO: 123 of at least 89% which have arabinofuranosidase activity. In an embodiment, the polypeptide has a sequence identity to SEQ ID NO: 123 of at least 90%. In an embodiment, the polypeptide has a sequence identity to SEQ ID NO: 123 of at least 91%. In an embodiment, the polypeptide has a sequence identity to SEQ ID NO: 123 of at least 92%. In an embodiment, the polypeptide has a sequence identity to SEQ ID NO: 123 of at least 93%. In an embodiment, the polypeptide has a sequence identity to SEQ ID NO: 123 of at least 94%. In an embodiment, the polypeptide has a sequence identity to SEQ ID NO: 123 of at least 95%. In an embodiment, the polypeptide has a sequence identity to SEQ ID NO: 123 of at least 96%. In an embodiment, the polypeptide has a sequence identity to SEQ ID NO: 123 of at least 97%. In an embodiment, the polypeptide has a sequence identity to SEQ ID NO: 123 of at least 98%. In an embodiment, the polypeptide has a sequence identity to SEQ ID NO: 123 of at least 99%.

In one embodiment, the polypeptides differ by up to 50 amino acids, e.g., between 1 and 33 amino acids, such as 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32 or 33 amino acids from SEQ ID NO: 123. In an embodiment, the polypeptide has at least 60%, at least 70%, at least 75%, at least 80%, at least 85%, at least 90%, at least 95%, or at least 100% of the activity of the polypeptide of SEQ ID NO: 123.

In one embodiment, the polypeptide preferably comprises or consists of the amino acid sequence of SEQ ID NO: 122 and/or SEQ ID NO: 123 or an allelic variant thereof; comprises the amino acid sequence of SEQ ID NO: 122 and/or SEQ ID NO: 123 and a N-terminal and/or C-terminal His-tag and/or HQ-tag; or is a fragment thereof having arabinofuranosidase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of the mature polypeptide of SEQ ID NO: 123. In another embodiment, the polypeptide comprises or consists of amino acids 1 to 302 of SEQ ID NO: 122. In another embodiment, the polypeptide comprises or consists of amino acids 1 to 302 of SEQ ID NO: 123. In an embodiment, the polypeptide has been isolated.

In a continuation of the fifteenth aspect, the invention relates to a polypeptide having arabinofuranosidase activity encoded by a polynucleotide that hybridizes under high stringency conditions or very high stringency conditions with (i) the mature polypeptide coding sequence of SEQ ID NO: 121 or (ii) the full-length complement of (i). In an embodiment, the polypeptide has been isolated.

In a continuation of the fifteenth aspect, the invention relates to a polypeptide having arabinofuranosidase activity encoded by a polynucleotide having a sequence identity to the mature polypeptide coding sequence of SEQ ID NO: 121 or the cDNA sequence thereof of at least 89%, e.g., at least 90%, at least 91%, at least 92%, at least 93%, at least 94%, at least 95%, at least 96%, at least 97%, at least 98%, at least 99%, or 100%. In a further embodiment, the polypeptide has been isolated.

In a continuation of the fifteenth aspect, the invention relates to variants of SEQ ID NO: 123 having arabinofuranosidase activity comprising one or more amino acid substitutions, and/or one or more amino acid deletions, and/or one or more amino acid insertions or any combination thereof at one or more (e.g., several) positions. In an embodiment, the number of positions comprising one or more amino acid substitutions, and/or one or more amino acid deletions, and/or one or more amino acid insertions or any combination thereof in SEQ ID NO: 123 is not more than 33, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32 or 33. In an embodiment, the number of positions comprising one or more amino acid substitutions, and/or one or more amino acid deletions, and/or one or more amino acid insertions or any combination thereof in SEQ ID NO: 123 is not more than 10, e.g., 1, 2, 3, 4, 5, 6, 7, 8, 9 or 10. In another embodiment, the number of substitutions, deletions, and/or insertions in SEQ ID NO: 123 is not more than 10, e.g., 1, 2, 3, 4, 5, 6, 7, 8, 9 or 10. In a further embodiment, the number of substitutions, preferably conservative substitutions, in SEQ ID NO: 123 is not more than 10, e.g., 1, 2, 3, 4, 5, 6, 7, 8, 9 or 10. In an embodiment, the variant has at least 60%, at least 70%, at least 75%, at least 80%, at least 85%, at least 90%, at least 95%, or at least 100% of the activity of the polypeptide of SEQ ID NO: 123. Examples of amino acid changes and conservative substitutions are described in the second aspect of the invention.

In an embodiment, the polypeptide of the fifteenth aspect comprises the motif [H/Y][L/M]F[F/S][A/C/H/S/T/V][A/D/G/N/R]D[D/E/N]G (SEQ ID NO: 1), preferably the motif [H/Y]LF[F/S][A/S/V][A/D/G]DNG (SEQ ID NO: 2), more preferable the motif YLFF[A/V][A/G]DNG (SEQ ID NO: 3), or even more preferably the motif YLFFAGDNG (SEQ ID NO: 4).

In a sixteenth aspect, the invention relates to polypeptides having arabinofuranosidase activity and having a sequence identity to the mature polypeptide of SEQ ID NO: 125 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, which have arabinofuranosidase activity. In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 amino acids from the mature polypeptide of SEQ ID NO: 125.

In a continuation of the sixteenth aspect, the invention further relates to polypeptides having a sequence identity to SEQ ID NO: 126 of at least 80% which have arabinofuranosidase activity. In an embodiment, the polypeptide has a sequence identity to SEQ ID NO: 126 of at least 85%. In an embodiment, the polypeptide has a sequence identity to SEQ ID NO: 126 of at least 86%. In an embodiment, the polypeptide has a sequence identity to SEQ ID NO: 126 of at least 87%. In an embodiment, the polypeptide has a sequence identity to SEQ ID NO: 126 of at least 88%. In an embodiment, the polypeptide has a sequence identity to SEQ ID NO: 126 of at least 89%. In an embodiment, the polypeptide has a sequence identity to SEQ ID NO: 126 of at least 90%. In an embodiment, the polypeptide has a sequence identity to SEQ ID NO: 126 of at least 91%. In an embodiment, the polypeptide has a sequence identity to SEQ ID NO: 126 of at least 92%. In an embodiment, the polypeptide has a sequence identity to SEQ ID NO: 126 of at least 93%. In an embodiment, the polypeptide has a sequence identity to SEQ ID NO: 126 of at least 94%. In an embodiment, the polypeptide has a sequence identity to SEQ ID NO: 126 of at least 95%. In an embodiment, the polypeptide has a sequence identity to SEQ ID NO: 126 of at least 96%. In an embodiment, the polypeptide has a sequence identity to SEQ ID NO: 126 of at least 97%. In an embodiment, the polypeptide has a sequence identity to SEQ ID NO: 126 of at least 98%. In an embodiment, the polypeptide has a sequence identity to SEQ ID NO: 126 of at least 99%.

In one embodiment, the polypeptides differ by up to 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 amino acids from SEQ ID NO: 126. In one embodiment, the polypeptides differ by up to 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 amino acids from SEQ ID NO: 129. In an embodiment, the polypeptide has at least 60%, at least 70%, at least 75%, at least 80%, at least 85%, at least 90%, at least 95%, or at least 100% of the activity of the polypeptide of SEQ ID NO: 126.

In one embodiment, the polypeptide preferably comprises or consists of the amino acid sequence of SEQ ID NO: 125 and/or SEQ ID NO: 126 or an allelic variant thereof; comprises the amino acid sequence of SEQ ID NO: 125 and/or SEQ ID NO: 126 and a N-terminal and/or C-terminal His-tag and/or HQ-tag such as SEQ ID NO: 129; or is a fragment thereof having arabinofuranosidase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of the mature polypeptide of SEQ ID NO: 125. In another embodiment, the polypeptide comprises or consists of the mature polypeptide of SEQ ID NO: 128. In another embodiment, the polypeptide comprises or consists of amino acids 1 to 453 of SEQ ID NO: 125. In another embodiment, the polypeptide comprises or consists of amino acids 1 to 453 of SEQ ID NO: 126. In another embodiment, the polypeptide comprises or consists of amino acids 1 to 461 of SEQ ID NO: 128. In another embodiment, the polypeptide comprises or consists of amino acids 1 to 461 of SEQ ID NO: 129. In an embodiment, the polypeptide has been isolated.

In a continuation of the sixteenth aspect, the invention relates to a polypeptide having arabinofuranosidase activity encoded by a polynucleotide that hybridizes under high stringency conditions or very high stringency conditions with (i) the mature polypeptide coding sequence of SEQ ID NO: 124 or (ii) the full-length complement of (i). In an embodiment, the polypeptide has been isolated.

In a continuation of the sixteenth aspect, the invention relates to a polypeptide having arabinofuranosidase activity encoded by a polynucleotide having a sequence identity to the mature polypeptide coding sequence of SEQ ID NO: 124 or the cDNA sequence thereof of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. In a further embodiment, the polypeptide has been isolated.

In a continuation of the sixteenth aspect, the invention relates to variants of SEQ ID NO: 126 having arabinofuranosidase activity comprising one or more amino acid substitutions, and/or one or more amino acid deletions, and/or one or more amino acid insertions or any combination thereof at one or more (e.g., several) positions. In an embodiment, the number of positions comprising one or more amino acid substitutions, and/or one or more amino acid deletions, and/or one or more amino acid insertions or any combination thereof in SEQ ID NO: 126 is not more than 50, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50. In an embodiment, the number of positions comprising one or more amino acid substitutions, and/or one or more amino acid deletions, and/or one or more amino acid insertions or any combination thereof in SEQ ID NO: 126 is not more than 10, e.g., 1, 2, 3, 4, 5, 6, 7, 8, 9 or 10. In another embodiment, the number of substitutions, deletions, and/or insertions in SEQ ID NO: 126 is not more than 10, e.g., 1, 2, 3, 4, 5, 6, 7, 8, 9 or 10. In a further embodiment, the number of substitutions, preferably conservative substitutions, in SEQ ID NO: 126 is not more than 10, e.g., 1, 2, 3, 4, 5, 6, 7, 8, 9 or 10. In an embodiment, the variant has at least 60%, at least 70%, at least 75%, at least 80%, at least 85%, at least 90%, at least 95%, or at least 100% of the activity of the polypeptide of SEQ ID NO: 126. Examples of amino acid changes and conservative substitutions are described in the second aspect of the invention.

In an embodiment, the polypeptide of the sixteenth aspect comprises the motif [H/Y][L/M]F[F/S][A/C/H/S/T/V][A/D/G/N/R]D[D/E/N]G (SEQ ID NO: 1).

In a seventeenth aspect, the invention relates to polypeptides having arabinofuranosidase activity and having a sequence identity to the mature polypeptide of SEQ ID NO: 137 of at least 85%, e.g., at least 86%, at least 87%, at least 88%, at least 89%, at least 90%, at least 91%, at least 92%, at least 93%, at least 94%, at least 95%, at least 96%, at least 97%, at least 98%, at least 99%, which have arabinofuranosidase activity. In one embodiment, the polypeptides differ by up to 46 amino acids, e.g., between 1 and 46 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45 or 46 amino acids from the mature polypeptide of SEQ ID NO: 137.

In a continuation of the seventeenth aspect, the invention further relates to polypeptides having a sequence identity to SEQ ID NO: 138 of at least 85% which have arabinofuranosidase activity. In an embodiment, the polypeptide has a sequence identity to SEQ ID NO: 138 of at least 86%. In an embodiment, the polypeptide has a sequence identity to SEQ ID NO: 138 of at least 87%. In an embodiment, the polypeptide has a sequence identity to SEQ ID NO: 138 of at least 88%. In an embodiment, the polypeptide has a sequence identity to SEQ ID NO: 138 of at least 89%. In an embodiment, the polypeptide has a sequence identity to SEQ ID NO: 138 of at least 90%. In an embodiment, the polypeptide has a sequence identity to SEQ ID NO: 138 of at least 91%. In an embodiment, the polypeptide has a sequence identity to SEQ ID NO: 138 of at least 92%. In an embodiment, the polypeptide has a sequence identity to SEQ ID NO: 138 of at least 93%. In an embodiment, the polypeptide has a sequence identity to SEQ ID NO: 138 of at least 94%. In an embodiment, the polypeptide has a sequence identity to SEQ ID NO: 138 of at least 95%. In an embodiment, the polypeptide has a sequence identity to SEQ ID NO: 138 of at least 96%. In an embodiment, the polypeptide has a sequence identity to SEQ ID NO: 138 of at least 97%. In an embodiment, the polypeptide has a sequence identity to SEQ ID NO: 138 of at least 98%. In an embodiment, the polypeptide has a sequence identity to SEQ ID NO: 138 of at least 99%.

In one embodiment, the polypeptides differ by up to 46 amino acids, e.g., between 1 and 46 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45 or 46 amino acids from SEQ ID NO: 138. In an embodiment, the polypeptide has at least 60%, at least 70%, at least 75%, at least 80%, at least 85%, at least 90%, at least 95%, or at least 100% of the activity of the polypeptide of SEQ ID NO: 138.

In one embodiment, the polypeptide preferably comprises or consists of the amino acid sequence of SEQ ID NO: 137 and/or SEQ ID NO: 138 or an allelic variant thereof; comprises the amino acid sequence of SEQ ID NO: 137 and/or SEQ ID NO: 138 and a N-terminal and/or C-terminal His-tag and/or HQ-tag; or is a fragment thereof having arabinofuranosidase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of the mature polypeptide of SEQ ID NO: 138. In another embodiment, the polypeptide comprises or consists of amino acids 1 to 309 of SEQ ID NO: 137. In another embodiment, the polypeptide comprises or consists of amino acids 1 to 309 of SEQ ID NO: 138. In an embodiment, the polypeptide has been isolated.

In a continuation of the seventeenth aspect, the invention relates to a polypeptide having arabinofuranosidase activity encoded by a polynucleotide that hybridizes under high stringency conditions or very high stringency conditions with (i) the mature polypeptide coding sequence of SEQ ID NO: 136 or (ii) the full-length complement of (i). In an embodiment, the polypeptide has been isolated.

In a continuation of the seventeenth aspect, the invention relates to a polypeptide having arabinofuranosidase activity encoded by a polynucleotide having a sequence identity to the mature polypeptide coding sequence of SEQ ID NO: 136 or the cDNA sequence thereof of at least 85%, e.g., at least 86%, at least 87%, at least 88%, at least 89%, at least 90%, at least 91%, at least 92%, at least 93%, at least 94%, at least 95%, at least 96%, at least 97%, at least 98%, at least 99%, or 100%. In a further embodiment, the polypeptide has been isolated.

In a continuation of the seventeenth aspect, the invention relates to variants of SEQ ID NO: 138 having arabinofuranosidase activity comprising one or more amino acid substitutions, and/or one or more amino acid deletions, and/or one or more amino acid insertions or any combination thereof at one or more (e.g., several) positions. In an embodiment, the number of positions comprising one or more amino acid substitutions, and/or one or more amino acid deletions, and/or one or more amino acid insertions or any combination thereof in SEQ ID NO: 138 is not more than 46, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, or 46. In an embodiment, the number of positions comprising one or more amino acid substitutions, and/or one or more amino acid deletions, and/or one or more amino acid insertions or any combination thereof in SEQ ID NO: 138 is not more than 10, e.g., 1, 2, 3, 4, 5, 6, 7, 8, 9 or 10. In another embodiment, the number of substitutions, deletions, and/or insertions in SEQ ID NO: 138 is not more than 10, e.g., 1, 2, 3, 4, 5, 6, 7, 8, 9 or 10. In a further embodiment, the number of substitutions, preferably conservative substitutions, in SEQ ID NO: 138 is not more than 10, e.g., 1, 2, 3, 4, 5, 6, 7, 8, 9 or 10. In an embodiment, the variant has at least 60%, at least 70%, at least 75%, at least 80%, at least 85%, at least 90%, at least 95%, or at least 100% of the activity of the polypeptide of SEQ ID NO: 138. Examples of amino acid changes and conservative substitutions are described in the second aspect of the invention.

In an embodiment, the polypeptide of the seventeenth aspect comprises the motif [H/Y][L/M]F[F/S][A/C/H/S/T/V][A/D/G/N/R]D[D/E/N]G (SEQ ID NO: 1), preferably the motif [H/Y]LF[F/S][A/S/V][A/D/G]DNG (SEQ ID NO: 2), more preferable the motif YLFF[A/V][A/G]DNG (SEQ ID NO: 3), or even more preferably the motif YLFFAGDNG (SEQ ID NO: 4).

In a eighteenth aspect, the invention relates to polypeptides having arabinofuranosidase activity and having a sequence identity to the mature polypeptide of SEQ ID NO: 140 of at least 89%, e.g., at least 90%, at least 91%, at least 92%, at least 93%, at least 94%, at least 95%, at least 96%, at least 97%, at least 98%, at least 99%, which have arabinofuranosidase activity. In one embodiment, the polypeptides differ by up to 33 amino acids, e.g., between 1 and 33 amino acids, such as 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32 or 33 amino acids from the mature polypeptide of SEQ ID NO: 140.

In a continuation of the eighteenth aspect, the invention further relates to polypeptides having a sequence identity to SEQ ID NO: 141 of at least 89% which have arabinofuranosidase activity. In an embodiment, the polypeptide has a sequence identity to SEQ ID NO: 141 of at least 90%. In an embodiment, the polypeptide has a sequence identity to SEQ ID NO: 141 of at least 91%. In an embodiment, the polypeptide has a sequence identity to SEQ ID NO: 141 of at least 92%. In an embodiment, the polypeptide has a sequence identity to SEQ ID NO: 141 of at least 93%. In an embodiment, the polypeptide has a sequence identity to SEQ ID NO: 141 of at least 94%. In an embodiment, the polypeptide has a sequence identity to SEQ ID NO: 141 of at least 95%. In an embodiment, the polypeptide has a sequence identity to SEQ ID NO: 141 of at least 96%. In an embodiment, the polypeptide has a sequence identity to SEQ ID NO: 141 of at least 97%. In an embodiment, the polypeptide has a sequence identity to SEQ ID NO: 141 of at least 98%. In an embodiment, the polypeptide has a sequence identity to SEQ ID NO: 141 of at least 99%.

In one embodiment, the polypeptides differ by up to 33 amino acids, e.g., between 1 and 33 amino acids, such as 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32 or 33 amino acids from SEQ ID NO: 141. In one embodiment, the polypeptides differ by up to 1 and 33 amino acids, such as 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32 or 33 amino acids from SEQ ID NO: 144. In an embodiment, the polypeptide has at least 60%, at least 70%, at least 75%, at least 80%, at least 85%, at least 90%, at least 95%, or at least 100% of the activity of the polypeptide of SEQ ID NO: 141.

In one embodiment, the polypeptide preferably comprises or consists of the amino acid sequence of SEQ ID NO: 140 and/or SEQ ID NO: 141 or an allelic variant thereof; comprises the amino acid sequence of SEQ ID NO: 140 and/or SEQ ID NO: 141 and a N-terminal and/or C-terminal His-tag and/or HQ-tag such as SEQ ID NO: 144; or is a fragment thereof having arabinofuranosidase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of the mature polypeptide of SEQ ID NO: 140. In another embodiment, the polypeptide comprises or consists of the mature polypeptide of SEQ ID NO: 143. In another embodiment, the polypeptide comprises or consists of amino acids 1 to 304 of SEQ ID NO: 140. In another embodiment, the polypeptide comprises or consists of amino acids 1 to 304 of SEQ ID NO: 141. In another embodiment, the polypeptide comprises or consists of amino acids 1 to 312 of SEQ ID NO: 143. In another embodiment, the polypeptide comprises or consists of amino acids 1 to 312 of SEQ ID NO: 144. In an embodiment, the polypeptide has been isolated.

In a continuation of the eighteenth aspect, the invention relates to a polypeptide having arabinofuranosidase activity encoded by a polynucleotide that hybridizes under very high stringency conditions with (i) the mature polypeptide coding sequence of SEQ ID NO: 139 or (ii) the full-length complement of (i). In an embodiment, the polypeptide has been isolated.

In a continuation of the eighteenth aspect, the invention relates to a polypeptide having arabinofuranosidase activity encoded by a polynucleotide having a sequence identity to the mature polypeptide coding sequence of SEQ ID NO: 139 or the cDNA sequence thereof of at least 89%, e.g., at least 90%, at least 91%, at least 92%, at least 93%, at least 94%, at least 95%, at least 96%, at least 97%, at least 98%, at least 99%, or 100%. In a further embodiment, the polypeptide has been isolated.

In a continuation of the eighteenth aspect, the invention relates to variants of SEQ ID NO: 141 having arabinofuranosidase activity comprising one or more amino acid substitutions, and/or one or more amino acid deletions, and/or one or more amino acid insertions or any combination thereof at one or more (e.g., several) positions. In an embodiment, the number of positions comprising one or more amino acid substitutions, and/or one or more amino acid deletions, and/or one or more amino acid insertions or any combination thereof in SEQ ID NO: 141 is not more than 33, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32 or 33. In an embodiment, the number of positions comprising one or more amino acid substitutions, and/or one or more amino acid deletions, and/or one or more amino acid insertions or any combination thereof in SEQ ID NO: 141 is not more than 10, e.g., 1, 2, 3, 4, 5, 6, 7, 8, 9 or 10. In another embodiment, the number of substitutions, deletions, and/or insertions in SEQ ID NO: 141 is not more than 10, e.g., 1, 2, 3, 4, 5, 6, 7, 8, 9 or 10. In a further embodiment, the number of substitutions, preferably conservative substitutions, in SEQ ID NO: 141 is not more than 10, e.g., 1, 2, 3, 4, 5, 6, 7, 8, 9 or 10. In an embodiment, the variant has at least 60%, at least 70%, at least 75%, at least 80%, at least 85%, at least 90%, at least 95%, or at least 100% of the activity of the polypeptide of SEQ ID NO: 141. Examples of amino acid changes and conservative substitutions are described in the second aspect of the invention.

In an embodiment, the polypeptide of the eighteenth aspect comprises the motif [H/Y][L/M]F[F/S][A/C/H/S/T/V][A/D/G/N/R]D[D/E/N]G (SEQ ID NO: 1), preferably the motif [H/Y]LF[F/S][A/S/V][A/D/G]DNG (SEQ ID NO: 2), more preferable the motif YLFF[A/V][A/G]DNG (SEQ ID NO: 3), or even more preferably the motif YLFFAGDNG (SEQ ID NO: 4).

In a nineteenth aspect, the invention relates to polypeptides having arabinofuranosidase activity and having a sequence identity to the mature polypeptide of SEQ ID NO: 146 of at least 86%, e.g., at least 87%, at least 88%, at least 89%, at least 90%, at least 91%, at least 92%, at least 93%, at least 94%, at least 95%, at least 96%, at least 97%, at least 98%, at least 99%, which have arabinofuranosidase activity. In one embodiment, the polypeptides differ by up to 42 amino acids, e.g., between 1 and 42 amino acids, such as 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41 or 42 amino acids from the mature polypeptide of SEQ ID NO: 146.

In a continuation of the nineteenth aspect, the invention further relates to polypeptides having a sequence identity to SEQ ID NO: 147 of at least 86% which have arabinofuranosidase activity. In an embodiment, the polypeptide has a sequence identity to SEQ ID NO: 147 of at least 87%. In an embodiment, the polypeptide has a sequence identity to SEQ ID NO: 147 of at least 88%. In an embodiment, the polypeptide has a sequence identity to SEQ ID NO: 147 of at least 89%. In an embodiment, the polypeptide has a sequence identity to SEQ ID NO: 147 of at least 90%. In an embodiment, the polypeptide has a sequence identity to SEQ ID NO: 147 of at least 91%. In an embodiment, the polypeptide has a sequence identity to SEQ ID NO: 147 of at least 92%. In an embodiment, the polypeptide has a sequence identity to SEQ ID NO: 147 of at least 93%. In an embodiment, the polypeptide has a sequence identity to SEQ ID NO: 147 of at least 94%. In an embodiment, the polypeptide has a sequence identity to SEQ ID NO: 147 of at least 95%. In an embodiment, the polypeptide has a sequence identity to SEQ ID NO: 147 of at least 96%. In an embodiment, the polypeptide has a sequence identity to SEQ ID NO: 147 of at least 97%. In an embodiment, the polypeptide has a sequence identity to SEQ ID NO: 147 of at least 98%. In an embodiment, the polypeptide has a sequence identity to SEQ ID NO: 147 of at least 99%.

In one embodiment, the polypeptides differ by up to 42 amino acids, e.g., between 1 and 42 amino acids, such as 42 amino acids, such as 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41 or 42 amino acids from SEQ ID NO: 147. In an embodiment, the polypeptide has at least 60%, at least 70%, at least 75%, at least 80%, at least 85%, at least 90%, at least 95%, or at least 100% of the activity of the polypeptide of SEQ ID NO: 147.

In one embodiment, the polypeptide preferably comprises or consists of the amino acid sequence of SEQ ID NO: 146 and/or SEQ ID NO: 147 or an allelic variant thereof; comprises the amino acid sequence of SEQ ID NO: 146 and/or SEQ ID NO: 147 and a N-terminal and/or C-terminal His-tag and/or HQ-tag; or is a fragment thereof having arabinofuranosidase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of the mature polypeptide of SEQ ID NO: 147. In another embodiment, the polypeptide comprises or consists of amino acids 1 to 302 of SEQ ID NO: 146. In another embodiment, the polypeptide comprises or consists of amino acids 1 to 302 of SEQ ID NO: 147. In an embodiment, the polypeptide has been isolated.

In a continuation of the nineteenth aspect, the invention relates to a polypeptide having arabinofuranosidase activity encoded by a polynucleotide that hybridizes under high stringency conditions or very high stringency conditions with (i) the mature polypeptide coding sequence of SEQ ID NO: 145 or (ii) the full-length complement of (i). In an embodiment, the polypeptide has been isolated.

In a continuation of the nineteenth aspect, the invention relates to a polypeptide having arabinofuranosidase activity encoded by a polynucleotide having a sequence identity to the mature polypeptide coding sequence of SEQ ID NO: 145 or the cDNA sequence thereof of at least 86%, e.g., at least 87%, at least 88%, at least 89%, at least 90%, at least 91%, at least 92%, at least 93%, at least 94%, at least 95%, at least 96%, at least 97%, at least 98%, at least 99%, or 100%. In a further embodiment, the polypeptide has been isolated.

In a continuation of the nineteenth aspect, the invention relates to variants of SEQ ID NO: 147 having arabinofuranosidase activity comprising one or more amino acid substitutions, and/or one or more amino acid deletions, and/or one or more amino acid insertions or any combination thereof at one or more (e.g., several) positions. In an embodiment, the number of positions comprising one or more amino acid substitutions, and/or one or more amino acid deletions, and/or one or more amino acid insertions or any combination thereof in SEQ ID NO: 147 is not more than 42, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41 or 42. In an embodiment, the number of positions comprising one or more amino acid substitutions, and/or one or more amino acid deletions, and/or one or more amino acid insertions or any combination thereof in SEQ ID NO: 147 is not more than 10, e.g., 1, 2, 3, 4, 5, 6, 7, 8, 9 or 10. In another embodiment, the number of substitutions, deletions, and/or insertions in SEQ ID NO: 147 is not more than 10, e.g., 1, 2, 3, 4, 5, 6, 7, 8, 9 or 10. In a further embodiment, the number of substitutions, preferably conservative substitutions, in SEQ ID NO: 147 is not more than 10, e.g., 1, 2, 3, 4, 5, 6, 7, 8, 9 or 10. In an embodiment, the variant has at least 60%, at least 70%, at least 75%, at least 80%, at least 85%, at least 90%, at least 95%, or at least 100% of the activity of the polypeptide of SEQ ID NO: 147. Examples of amino acid changes and conservative substitutions are described in the second aspect of the invention.

In an embodiment, the polypeptide of the nineteenth aspect comprises the motif [H/Y][L/M]F[F/S][A/C/H/S/T/V][A/D/G/N/R]D[D/E/N]G (SEQ ID NO: 1), preferably the motif [H/Y]LF[F/S][A/S/V][A/D/G]DNG (SEQ ID NO: 2), more preferable the motif YLFF[A/V][A/G]DNG (SEQ ID NO: 3), or even more preferably the motif YLFFAGDNG (SEQ ID NO: 4).

In a twentieth aspect, the invention relates to polypeptides having arabinofuranosidase activity and having a sequence identity to the mature polypeptide of SEQ ID NO: 155 of at least 96.4%, e.g., at least 96.7%, at least 97.0%, at least 97.3%, at least 97.6%, at least 97.9%, at least 98.2%, at least 98.5%, at least 98.8%, at least 91.1%, at least 99.4%, at least 99.7% which have arabinofuranosidase activity. In one embodiment, the polypeptides differ by up to 11 amino acids, e.g., between 1 and 11 amino acids, such as 1, 2, 3, 4, 5, 6, 7, 8, 9, 10 or 11 amino acids from the mature polypeptide of SEQ ID NO: 155. In an embodiment, the polypeptide has at least 60%, at least 70%, at least 75%, at least 80%, at least 85%, at least 90%, at least 95%, or at least 100% of the activity of the polypeptide of SEQ ID NO: 155.

In a continuation of the twentieth aspect, the invention further relates to polypeptides having a sequence identity to SEQ ID NO: 156 of at least 96.4% which have arabinofuranosidase activity. In an embodiment, the polypeptide has a sequence identity to SEQ ID NO: 156 of at least 96.7%. In an embodiment, the polypeptide has a sequence identity to SEQ ID NO: 156 of at least 97.0%. In an embodiment, the polypeptide has a sequence identity to SEQ ID NO: 156 of at least 97.3%. In an embodiment, the polypeptide has a sequence identity to SEQ ID NO: 156 of at least 97.6%. In an embodiment, the polypeptide has a sequence identity to SEQ ID NO: 156 of at least 97.9%. In an embodiment, the polypeptide has a sequence identity to SEQ ID NO: 156 of at least 98.2%. In an embodiment, the polypeptide has a sequence identity to SEQ ID NO: 156 of at least 98.5%. In an embodiment, the polypeptide has a sequence identity to SEQ ID NO: 156 of at least 98.8%. In an embodiment, the polypeptide has a sequence identity to SEQ ID NO: 156 of at least 99.1%. In an embodiment, the polypeptide has a sequence identity to SEQ ID NO: 156 of at least 99.4%. In an embodiment, the polypeptide has a sequence identity to SEQ ID NO: 156 of at least 99.7%.

In one embodiment, the polypeptides differ by up to 11 amino acids, e.g., between 1 and 11 amino acids, such as 1, 2, 3, 4, 5, 6, 7, 8, 9, 10 or 11 amino acids from SEQ ID NO: 156.

In one embodiment, the polypeptide preferably comprises or consists of the amino acid sequence of SEQ ID NO: 155 and/or SEQ ID NO: 156 or an allelic variant thereof; comprises the amino acid sequence of SEQ ID NO: 155 and/or SEQ ID NO: 156 and a N-terminal and/or C-terminal His-tag and/or HQ-tag; or is a fragment thereof having arabinofuranosidase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of the mature polypeptide of SEQ ID NO: 156. In another embodiment, the polypeptide comprises or consists of amino acids 1 to 316 of SEQ ID NO: 155. In another embodiment, the polypeptide comprises or consists of amino acids 1 to 316 of SEQ ID NO: 156. In an embodiment, the polypeptide has been isolated.

In a continuation of the twentieth aspect, the invention relates to a polypeptide having arabinofuranosidase activity encoded by a polynucleotide that hybridizes under very high stringency conditions with (i) the mature polypeptide coding sequence of SEQ ID NO: 154 or (ii) the full-length complement of (i). In an embodiment, the polypeptide has been isolated.

In a continuation of the twentieth aspect, the invention relates to a polypeptide having arabinofuranosidase activity encoded by a polynucleotide having a sequence identity to the mature polypeptide coding sequence of SEQ ID NO: 154 or the cDNA sequence thereof of at least 96.4%, e.g., at least 96.7%, at least 97.0%, at least 97.3%, at least 97.6%, at least 97.9%, at least 98.2%, at least 98.5%, at least 98.8%, at least 91.1%, at least 99.4%, at least 99.7%, or 100%. In a further embodiment, the polypeptide has been isolated.

In a continuation of the twentieth aspect, the invention relates to variants of SEQ ID NO: 156 having arabinofuranosidase activity comprising one or more amino acid substitutions, and/or one or more amino acid deletions, and/or one or more amino acid insertions or any combination thereof at one or more (e.g., several) positions. In an embodiment, the number of positions comprising one or more amino acid substitutions, and/or one or more amino acid deletions, and/or one or more amino acid insertions or any combination thereof in SEQ ID NO: 156 is not more than 10, e.g., 1, 2, 3, 4, 5, 6, 7, 8, 9 or 10. In another embodiment, the number of substitutions, deletions, and/or insertions in SEQ ID NO: 156 is not more than 10, e.g., 1, 2, 3, 4, 5, 6, 7, 8, 9 or 10. In a further embodiment, the number of substitutions, preferably conservative substitutions, in SEQ ID NO: 156 is not more than 10, e.g., 1, 2, 3, 4, 5, 6, 7, 8, 9 or 10. In an embodiment, the variant has at least 60%, at least 70%, at least 75%, at least 80%, at least 85%, at least 90%, at least 95%, or at least 100% of the activity of the polypeptide of SEQ ID NO: 155. Examples of amino acid changes and conservative substitutions are described in the second aspect of the invention.

In an embodiment, the polypeptide of the twentieth aspect comprises the motif [H/Y][L/M]F[F/S][A/C/H/S/T/V][A/D/G/N/R]D[D/E/N]G (SEQ ID NO: 1), preferably the motif [H/Y]LF[F/S][A/S/V][A/D/G]DNG (SEQ ID NO: 2), more preferable the motif [H/Y]LFSSDDNG (SEQ ID NO: 5), or even more preferably the motif YLFSSDDNG (SEQ ID NO: 6).

In a twenty-first aspect, the invention relates to polypeptides having arabinofuranosidase activity and having a sequence identity to the mature polypeptide of SEQ ID NO: 161 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, which have arabinofuranosidase activity. In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 amino acids from the mature polypeptide of SEQ ID NO: 161.

In a continuation of the twenty-first aspect, the invention further relates to polypeptides having a sequence identity to SEQ ID NO: 162 of at least 80% which have arabinofuranosidase activity. In an embodiment, the polypeptide has a sequence identity to SEQ ID NO: 162 of at least 85%. In an embodiment, the polypeptide has a sequence identity to SEQ ID NO: 162 of at least 86%. In an embodiment, the polypeptide has a sequence identity to SEQ ID NO: 162 of at least 87%. In an embodiment, the polypeptide has a sequence identity to SEQ ID NO: 162 of at least 88%. In an embodiment, the polypeptide has a sequence identity to SEQ ID NO: 162 of at least 89%. In an embodiment, the polypeptide has a sequence identity to SEQ ID NO: 162 of at least 90%. In an embodiment, the polypeptide has a sequence identity to SEQ ID NO: 162 of at least 91%. In an embodiment, the polypeptide has a sequence identity to SEQ ID NO: 162 of at least 92%. In an embodiment, the polypeptide has a sequence identity to SEQ ID NO: 162 of at least 93%. In an embodiment, the polypeptide has a sequence identity to SEQ ID NO: 162 of at least 94%. In an embodiment, the polypeptide has a sequence identity to SEQ ID NO: 162 of at least 95%. In an embodiment, the polypeptide has a sequence identity to SEQ ID NO: 162 of at least 96%. In an embodiment, the polypeptide has a sequence identity to SEQ ID NO: 162 of at least 97%. In an embodiment, the polypeptide has a sequence identity to SEQ ID NO: 162 of at least 98%. In an embodiment, the polypeptide has a sequence identity to SEQ ID NO: 162 of at least 99%.

In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 amino acids from SEQ ID NO: 162. In an embodiment, the polypeptide has at least 60%, at least 70%, at least 75%, at least 80%, at least 85%, at least 90%, at least 95%, or at least 100% of the activity of the polypeptide of SEQ ID NO: 162.

In one embodiment, the polypeptide preferably comprises or consists of the amino acid sequence of SEQ ID NO: 161 and/or SEQ ID NO: 162 or an allelic variant thereof; comprises the amino acid sequence of SEQ ID NO: 161 and/or SEQ ID NO: 162 and a N-terminal and/or C-terminal His-tag and/or HQ-tag; or is a fragment thereof having arabinofuranosidase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of the mature polypeptide of SEQ ID NO: 162. In another embodiment, the polypeptide comprises or consists of amino acids 1 to 303 of SEQ ID NO: 161. In another embodiment, the polypeptide comprises or consists of amino acids 1 to 303 of SEQ ID NO: 162. In an embodiment, the polypeptide has been isolated.

In a continuation of the twenty-first aspect, the invention relates to a polypeptide having arabinofuranosidase activity encoded by a polynucleotide that hybridizes under high stringency conditions or very high stringency conditions with (i) the mature polypeptide coding sequence of SEQ ID NO: 160 or (ii) the full-length complement of (i). In an embodiment, the polypeptide has been isolated.

In a continuation of the twenty-first aspect, the invention relates to a polypeptide having arabinofuranosidase activity encoded by a polynucleotide having a sequence identity to the mature polypeptide coding sequence of SEQ ID NO: 160 or the cDNA sequence thereof of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. In a further embodiment, the polypeptide has been isolated.

In a continuation of the twenty-first aspect, the invention relates to variants of SEQ ID NO: 162 having arabinofuranosidase activity comprising one or more amino acid substitutions, and/or one or more amino acid deletions, and/or one or more amino acid insertions or any combination thereof at one or more (e.g., several) positions. In an embodiment, the number of positions comprising one or more amino acid substitutions, and/or one or more amino acid deletions, and/or one or more amino acid insertions or any combination thereof in SEQ ID NO: 162 is not more than 50, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50. In an embodiment, the number of positions comprising one or more amino acid substitutions, and/or one or more amino acid deletions, and/or one or more amino acid insertions or any combination thereof in SEQ ID NO: 162 is not more than 10, e.g., 1, 2, 3, 4, 5, 6, 7, 8, 9 or 10. In another embodiment, the number of substitutions, deletions, and/or insertions in SEQ ID NO: 162 is not more than 10, e.g., 1, 2, 3, 4, 5, 6, 7, 8, 9 or 10. In a further embodiment, the number of substitutions, preferably conservative substitutions, in SEQ ID NO: 162 is not more than 10, e.g., 1, 2, 3, 4, 5, 6, 7, 8, 9 or 10. In an embodiment, the variant has at least 60%, at least 70%, at least 75%, at least 80%, at least 85%, at least 90%, at least 95%, or at least 100% of the activity of the polypeptide of SEQ ID NO: 162. Examples of amino acid changes and conservative substitutions are described in the second aspect of the invention.

In an embodiment, the polypeptide of the twenty-first aspect comprises the motif [H/Y][L/M]F[F/S][A/C/H/S/T/V][A/D/G/N/R]D[D/E/N]G (SEQ ID NO: 1), preferably the motif [H/Y]LF[F/S][A/S/V][A/D/G]DNG (SEQ ID NO: 2), more preferable the motif YLFF[A/V][A/G]DNG (SEQ ID NO: 3), or even more preferably the motif YLFFAGDNG (SEQ ID NO: 4).

In a twenty-second aspect, the invention relates to polypeptides having arabinofuranosidase activity and having a sequence identity to the mature polypeptide of SEQ ID NO: 164 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, which have arabinofuranosidase activity. In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 amino acids from the mature polypeptide of SEQ ID NO: 164.

In a continuation of the twenty-second aspect, the invention further relates to polypeptides having a sequence identity to SEQ ID NO: 165 of at least 80% which have arabinofuranosidase activity. In an embodiment, the polypeptide has a sequence identity to SEQ ID NO: 165 of at least 85%. In an embodiment, the polypeptide has a sequence identity to SEQ ID NO: 165 of at least 86%. In an embodiment, the polypeptide has a sequence identity to SEQ ID NO: 165 of at least 87%. In an embodiment, the polypeptide has a sequence identity to SEQ ID NO: 165 of at least 88%. In an embodiment, the polypeptide has a sequence identity to SEQ ID NO: 165 of at least 89%. In an embodiment, the polypeptide has a sequence identity to SEQ ID NO: 165 of at least 90%. In an embodiment, the polypeptide has a sequence identity to SEQ ID NO: 165 of at least 91%. In an embodiment, the polypeptide has a sequence identity to SEQ ID NO: 165 of at least 92%. In an embodiment, the polypeptide has a sequence identity to SEQ ID NO: 165 of at least 93%. In an embodiment, the polypeptide has a sequence identity to SEQ ID NO: 165 of at least 94%. In an embodiment, the polypeptide has a sequence identity to SEQ ID NO: 165 of at least 95%. In an embodiment, the polypeptide has a sequence identity to SEQ ID NO: 165 of at least 96%. In an embodiment, the polypeptide has a sequence identity to SEQ ID NO: 165 of at least 97%. In an embodiment, the polypeptide has a sequence identity to SEQ ID NO: 165 of at least 98%. In an embodiment, the polypeptide has a sequence identity to SEQ ID NO: 165 of at least 99%.

In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 amino acids from SEQ ID NO: 165. In an embodiment, the polypeptide has at least 60%, at least 70%, at least 75%, at least 80%, at least 85%, at least 90%, at least 95%, or at least 100% of the activity of the polypeptide of SEQ ID NO: 165.

In one embodiment, the polypeptide preferably comprises or consists of the amino acid sequence of SEQ ID NO: 164 and/or SEQ ID NO: 165 or an allelic variant thereof; comprises the amino acid sequence of SEQ ID NO: 164 and/or SEQ ID NO: 165 and a N-terminal and/or C-terminal His-tag and/or HQ-tag; or is a fragment thereof having arabinofuranosidase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of the mature polypeptide of SEQ ID NO: 165. In another embodiment, the polypeptide comprises or consists of amino acids 1 to 361 of SEQ ID NO: 164. In another embodiment, the polypeptide comprises or consists of amino acids 1 to 361 of SEQ ID NO: 165. In an embodiment, the polypeptide has been isolated.

In a continuation of the twenty-second aspect, the invention relates to a polypeptide having arabinofuranosidase activity encoded by a polynucleotide that hybridizes under high stringency conditions or very high stringency conditions with (i) the mature polypeptide coding sequence of SEQ ID NO: 163 or (ii) the full-length complement of (i). In an embodiment, the polypeptide has been isolated.

In a continuation of the twenty-second aspect, the invention relates to a polypeptide having arabinofuranosidase activity encoded by a polynucleotide having a sequence identity to the mature polypeptide coding sequence of SEQ ID NO: 163 or the cDNA sequence thereof of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. In a further embodiment, the polypeptide has been isolated.

In a continuation of the twenty-second aspect, the invention relates to variants of SEQ ID NO: 165 having arabinofuranosidase activity comprising one or more amino acid substitutions, and/or one or more amino acid deletions, and/or one or more amino acid insertions or any combination thereof at one or more (e.g., several) positions. In an embodiment, the number of positions comprising one or more amino acid substitutions, and/or one or more amino acid deletions, and/or one or more amino acid insertions or any combination thereof in SEQ ID NO: 165 is not more than 50, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50. In an embodiment, the number of positions comprising one or more amino acid substitutions, and/or one or more amino acid deletions, and/or one or more amino acid insertions or any combination thereof in SEQ ID NO: 165 is not more than 10, e.g., 1, 2, 3, 4, 5, 6, 7, 8, 9 or 10. In another embodiment, the number of substitutions, deletions, and/or insertions in SEQ ID NO: 165 is not more than 10, e.g., 1, 2, 3, 4, 5, 6, 7, 8, 9 or 10. In a further embodiment, the number of substitutions, preferably conservative substitutions, in SEQ ID NO: 165 is not more than 10, e.g., 1, 2, 3, 4, 5, 6, 7, 8, 9 or 10. In an embodiment, the variant has at least 60%, at least 70%, at least 75%, at least 80%, at least 85%, at least 90%, at least 95%, or at least 100% of the activity of the polypeptide of SEQ ID NO: 165. Examples of amino acid changes and conservative substitutions are described in the second aspect of the invention.

In an embodiment, the polypeptide of the twenty-second aspect comprises the motif [H/Y][L/M]F[F/S][A/C/H/S/T/V][A/D/G/N/R]D[D/E/N]G (SEQ ID NO: 1), preferably the motif [H/Y]LF[F/S][A/S/V][A/D/G]DNG (SEQ ID NO: 2), more preferable the motif YLFF[A/V][A/G]DNG (SEQ ID NO: 3), or even more preferably the motif YLFFAGDNG (SEQ ID NO: 4).

In a twenty-third aspect, the invention relates to polypeptides having arabinofuranosidase activity and having a sequence identity to the mature polypeptide of SEQ ID NO: 167 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, which have arabinofuranosidase activity. In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 amino acids from the mature polypeptide of SEQ ID NO: 167.

In a continuation of the twenty-third aspect, the invention further relates to polypeptides having a sequence identity to SEQ ID NO: 168 of at least 80% which have arabinofuranosidase activity. In an embodiment, the polypeptide has a sequence identity to SEQ ID NO: 168 of at least 85%. In an embodiment, the polypeptide has a sequence identity to SEQ ID NO: 168 of at least 86%. In an embodiment, the polypeptide has a sequence identity to SEQ ID NO: 168 of at least 87%. In an embodiment, the polypeptide has a sequence identity to SEQ ID NO: 168 of at least 88%. In an embodiment, the polypeptide has a sequence identity to SEQ ID NO: 168 of at least 89%. In an embodiment, the polypeptide has a sequence identity to SEQ ID NO: 168 of at least 90%. In an embodiment, the polypeptide has a sequence identity to SEQ ID NO: 168 of at least 91%. In an embodiment, the polypeptide has a sequence identity to SEQ ID NO: 168 of at least 92%. In an embodiment, the polypeptide has a sequence identity to SEQ ID NO: 168 of at least 93%. In an embodiment, the polypeptide has a sequence identity to SEQ ID NO: 168 of at least 94%. In an embodiment, the polypeptide has a sequence identity to SEQ ID NO: 168 of at least 95%. In an embodiment, the polypeptide has a sequence identity to SEQ ID NO: 168 of at least 96%. In an embodiment, the polypeptide has a sequence identity to SEQ ID NO: 168 of at least 97%. In an embodiment, the polypeptide has a sequence identity to SEQ ID NO: 168 of at least 98%. In an embodiment, the polypeptide has a sequence identity to SEQ ID NO: 168 of at least 99%.

In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 amino acids from SEQ ID NO: 168. In an embodiment, the polypeptide has at least 60%, at least 70%, at least 75%, at least 80%, at least 85%, at least 90%, at least 95%, or at least 100% of the activity of the polypeptide of SEQ ID NO: 168.

In one embodiment, the polypeptide preferably comprises or consists of the amino acid sequence of SEQ ID NO: 167 and/or SEQ ID NO: 168 or an allelic variant thereof; comprises the amino acid sequence of SEQ ID NO: 167 and/or SEQ ID NO: 168 and a N-terminal and/or C-terminal His-tag and/or HQ-tag; or is a fragment thereof having arabinofuranosidase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of the mature polypeptide of SEQ ID NO: 168. In another embodiment, the polypeptide comprises or consists of amino acids 1 to 373 of SEQ ID NO: 167. In another embodiment, the polypeptide comprises or consists of amino acids 1 to 373 of SEQ ID NO: 168. In an embodiment, the polypeptide has been isolated.

In a continuation of the twenty-third aspect, the invention relates to a polypeptide having arabinofuranosidase activity encoded by a polynucleotide that hybridizes under high stringency conditions or very high stringency conditions with (i) the mature polypeptide coding sequence of SEQ ID NO: 166 or (ii) the full-length complement of (i). In an embodiment, the polypeptide has been isolated.

In a continuation of the twenty-third aspect, the invention relates to a polypeptide having arabinofuranosidase activity encoded by a polynucleotide having a sequence identity to the mature polypeptide coding sequence of SEQ ID NO: 166 or the cDNA sequence thereof of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. In a further embodiment, the polypeptide has been isolated.

In a continuation of the twenty-third aspect, the invention relates to variants of SEQ ID NO: 168 having arabinofuranosidase activity comprising one or more amino acid substitutions, and/or one or more amino acid deletions, and/or one or more amino acid insertions or any combination thereof at one or more (e.g., several) positions. In an embodiment, the number of positions comprising one or more amino acid substitutions, and/or one or more amino acid deletions, and/or one or more amino acid insertions or any combination thereof in SEQ ID NO: 168 is not more than 50, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50. In an embodiment, the number of positions comprising one or more amino acid substitutions, and/or one or more amino acid deletions, and/or one or more amino acid insertions or any combination thereof in SEQ ID NO: 168 is not more than 10, e.g., 1, 2, 3, 4, 5, 6, 7, 8, 9 or 10. In another embodiment, the number of substitutions, deletions, and/or insertions in SEQ ID NO: 168 is not more than 10, e.g., 1, 2, 3, 4, 5, 6, 7, 8, 9 or 10. In a further embodiment, the number of substitutions, preferably conservative substitutions, in SEQ ID NO: 168 is not more than 10, e.g., 1, 2, 3, 4, 5, 6, 7, 8, 9 or 10. In an embodiment, the variant has at least 60%, at least 70%, at least 75%, at least 80%, at least 85%, at least 90%, at least 95%, or at least 100% of the activity of the polypeptide of SEQ ID NO: 168. Examples of amino acid changes and conservative substitutions are described in the second aspect of the invention.

In an embodiment, the polypeptide of the twenty-third aspect comprises the motif [H/Y][L/M]F[F/S][A/C/H/S/T/V][A/D/G/N/R]D[D/E/N]G (SEQ ID NO: 1), preferably the motif [H/Y]LF[F/S][A/S/V][A/D/G]DNG (SEQ ID NO: 2), more preferable the motif YLFF[A/V][A/G]DNG (SEQ ID NO: 3), or even more preferably the motif YLFFAGDNG (SEQ ID NO: 4).

In a twenty-fourth aspect, the invention relates to polypeptides having arabinofuranosidase activity and having a sequence identity to the mature polypeptide of SEQ ID NO: 170 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, which have arabinofuranosidase activity. In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 amino acids from the mature polypeptide of SEQ ID NO: 170.

In a continuation of the twenty-fourth aspect, the invention further relates to polypeptides having a sequence identity to SEQ ID NO: 171 of at least 80% which have arabinofuranosidase activity. In an embodiment, the polypeptide has a sequence identity to SEQ ID NO: 171 of at least 85%. In an embodiment, the polypeptide has a sequence identity to SEQ ID NO: 171 of at least 86%. In an embodiment, the polypeptide has a sequence identity to SEQ ID NO: 171 of at least 87%. In an embodiment, the polypeptide has a sequence identity to SEQ ID NO: 171 of at least 88%. In an embodiment, the polypeptide has a sequence identity to SEQ ID NO: 171 of at least 89%. In an embodiment, the polypeptide has a sequence identity to SEQ ID NO: 171 of at least 90%. In an embodiment, the polypeptide has a sequence identity to SEQ ID NO: 171 of at least 91%. In an embodiment, the polypeptide has a sequence identity to SEQ ID NO: 171 of at least 92%. In an embodiment, the polypeptide has a sequence identity to SEQ ID NO: 171 of at least 93%. In an embodiment, the polypeptide has a sequence identity to SEQ ID NO: 171 of at least 94%. In an embodiment, the polypeptide has a sequence identity to SEQ ID NO: 171 of at least 95%. In an embodiment, the polypeptide has a sequence identity to SEQ ID NO: 171 of at least 96%. In an embodiment, the polypeptide has a sequence identity to SEQ ID NO: 171 of at least 97%. In an embodiment, the polypeptide has a sequence identity to SEQ ID NO: 171 of at least 98%. In an embodiment, the polypeptide has a sequence identity to SEQ ID NO: 171 of at least 99%.

In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 amino acids from SEQ ID NO: 171. In an embodiment, the polypeptide has at least 60%, at least 70%, at least 75%, at least 80%, at least 85%, at least 90%, at least 95%, or at least 100% of the activity of the polypeptide of SEQ ID NO: 171.

In one embodiment, the polypeptide preferably comprises or consists of the amino acid sequence of SEQ ID NO: 170 and/or SEQ ID NO: 171 or an allelic variant thereof; comprises the amino acid sequence of SEQ ID NO: 170 and/or SEQ ID NO: 171 and a N-terminal and/or C-terminal His-tag and/or HQ-tag; or is a fragment thereof having arabinofuranosidase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of the mature polypeptide of SEQ ID NO: 171. In another embodiment, the polypeptide comprises or consists of amino acids 1 to 302 of SEQ ID NO: 170. In another embodiment, the polypeptide comprises or consists of amino acids 1 to 302 of SEQ ID NO: 171. In an embodiment, the polypeptide has been isolated.

In a continuation of the twenty-fourth aspect, the invention relates to a polypeptide having arabinofuranosidase activity encoded by a polynucleotide that hybridizes under high stringency conditions or very high stringency conditions with (i) the mature polypeptide coding sequence of SEQ ID NO: 169 or (ii) the full-length complement of (i). In an embodiment, the polypeptide has been isolated.

In a continuation of the twenty-fourth aspect, the invention relates to a polypeptide having arabinofuranosidase activity encoded by a polynucleotide having a sequence identity to the mature polypeptide coding sequence of SEQ ID NO: 169 or the cDNA sequence thereof of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. In a further embodiment, the polypeptide has been isolated.

In a continuation of the twenty-fourth aspect, the invention relates to variants of SEQ ID NO: 171 having arabinofuranosidase activity comprising one or more amino acid substitutions, and/or one or more amino acid deletions, and/or one or more amino acid insertions or any combination thereof at one or more (e.g., several) positions. In an embodiment, the number of positions comprising one or more amino acid substitutions, and/or one or more amino acid deletions, and/or one or more amino acid insertions or any combination thereof in SEQ ID NO: 171 is not more than 50, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50. In an embodiment, the number of positions comprising one or more amino acid substitutions, and/or one or more amino acid deletions, and/or one or more amino acid insertions or any combination thereof in SEQ ID NO: 171 is not more than 10, e.g., 1, 2, 3, 4, 5, 6, 7, 8, 9 or 10. In another embodiment, the number of substitutions, deletions, and/or insertions in SEQ ID NO: 171 is not more than 10, e.g., 1, 2, 3, 4, 5, 6, 7, 8, 9 or 10. In a further embodiment, the number of substitutions, preferably conservative substitutions, in SEQ ID NO: 171 is not more than 10, e.g., 1, 2, 3, 4, 5, 6, 7, 8, 9 or 10. In an embodiment, the variant has at least 60%, at least 70%, at least 75%, at least 80%, at least 85%, at least 90%, at least 95%, or at least 100% of the activity of the polypeptide of SEQ ID NO: 171. Examples of amino acid changes and conservative substitutions are described in the second aspect of the invention.

In an embodiment, the polypeptide of the twenty-fourth aspect comprises the motif [H/Y][L/M]F[F/S][A/C/H/S/T/V][A/D/G/N/R]D[D/E/N]G (SEQ ID NO: 1), preferably the motif [H/Y]LF[F/S][A/S/V][A/D/G]DNG (SEQ ID NO: 2), more preferable the motif YLFF[A/V][A/G]DNG (SEQ ID NO: 3), or even more preferably the motif YLFFAGDNG (SEQ ID NO: 4).

In a twenty-fifth aspect, the invention relates to polypeptides having arabinofuranosidase activity and having a sequence identity to the mature polypeptide of SEQ ID NO: 173 of at least 82%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, which have arabinofuranosidase activity. In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 amino acids from the mature polypeptide of SEQ ID NO: 173.

In a continuation of the twenty-fifth aspect, the invention further relates to polypeptides having a sequence identity to SEQ ID NO: 174 of at least 82% which have arabinofuranosidase activity. In an embodiment, the polypeptide has a sequence identity to SEQ ID NO: 174 of at least 85%. In an embodiment, the polypeptide has a sequence identity to SEQ ID NO: 174 of at least 86%. In an embodiment, the polypeptide has a sequence identity to SEQ ID NO: 174 of at least 87%. In an embodiment, the polypeptide has a sequence identity to SEQ ID NO: 174 of at least 88%. In an embodiment, the polypeptide has a sequence identity to SEQ ID NO: 174 of at least 89%. In an embodiment, the polypeptide has a sequence identity to SEQ ID NO: 174 of at least 90%. In an embodiment, the polypeptide has a sequence identity to SEQ ID NO: 174 of at least 91%. In an embodiment, the polypeptide has a sequence identity to SEQ ID NO: 174 of at least 92%. In an embodiment, the polypeptide has a sequence identity to SEQ ID NO: 174 of at least 93%. In an embodiment, the polypeptide has a sequence identity to SEQ ID NO: 174 of at least 94%. In an embodiment, the polypeptide has a sequence identity to SEQ ID NO: 174 of at least 95%. In an embodiment, the polypeptide has a sequence identity to SEQ ID NO: 174 of at least 96%. In an embodiment, the polypeptide has a sequence identity to SEQ ID NO: 174 of at least 97%. In an embodiment, the polypeptide has a sequence identity to SEQ ID NO: 174 of at least 98%. In an embodiment, the polypeptide has a sequence identity to SEQ ID NO: 174 of at least 99%.

In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 amino acids from SEQ ID NO: 174. In an embodiment, the polypeptide has at least 60%, at least 70%, at least 75%, at least 80%, at least 85%, at least 90%, at least 95%, or at least 100% of the activity of the polypeptide of SEQ ID NO: 174.

In one embodiment, the polypeptide preferably comprises or consists of the amino acid sequence of SEQ ID NO: 173 and/or SEQ ID NO: 174 or an allelic variant thereof; comprises the amino acid sequence of SEQ ID NO: 173 and/or SEQ ID NO: 174 and a N-terminal and/or C-terminal His-tag and/or HQ-tag; or is a fragment thereof having arabinofuranosidase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of the mature polypeptide of SEQ ID NO: 174. In another embodiment, the polypeptide comprises or consists of amino acids 1 to 364 of SEQ ID NO: 173. In another embodiment, the polypeptide comprises or consists of amino acids 1 to 364 of SEQ ID NO: 174. In an embodiment, the polypeptide has been isolated.

In a continuation of the twenty-fifth aspect, the invention relates to a polypeptide having arabinofuranosidase activity encoded by a polynucleotide that hybridizes under high stringency conditions or very high stringency conditions with (i) the mature polypeptide coding sequence of SEQ ID NO: 172 or (ii) the full-length complement of (i). In an embodiment, the polypeptide has been isolated.

In a continuation of the twenty-fifth aspect, the invention relates to a polypeptide having arabinofuranosidase activity encoded by a polynucleotide having a sequence identity to the mature polypeptide coding sequence of SEQ ID NO: 172 or the cDNA sequence thereof of at least 82%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. In a further embodiment, the polypeptide has been isolated.

In a continuation of the twenty-fifth aspect, the invention relates to variants of SEQ ID NO: 174 having arabinofuranosidase activity comprising one or more amino acid substitutions, and/or one or more amino acid deletions, and/or one or more amino acid insertions or any combination thereof at one or more (e.g., several) positions. In an embodiment, the number of positions comprising one or more amino acid substitutions, and/or one or more amino acid deletions, and/or one or more amino acid insertions or any combination thereof in SEQ ID NO: 174 is not more than 50, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50. In an embodiment, the number of positions comprising one or more amino acid substitutions, and/or one or more amino acid deletions, and/or one or more amino acid insertions or any combination thereof in SEQ ID NO: 174 is not more than 10, e.g., 1, 2, 3, 4, 5, 6, 7, 8, 9 or 10. In another embodiment, the number of substitutions, deletions, and/or insertions in SEQ ID NO: 174 is not more than 10, e.g., 1, 2, 3, 4, 5, 6, 7, 8, 9 or 10. In a further embodiment, the number of substitutions, preferably conservative substitutions, in SEQ ID NO: 174 is not more than 10, e.g., 1, 2, 3, 4, 5, 6, 7, 8, 9 or 10. In an embodiment, the variant has at least 60%, at least 70%, at least 75%, at least 80%, at least 85%, at least 90%, at least 95%, or at least 100% of the activity of the polypeptide of SEQ ID NO: 174. Examples of amino acid changes and conservative substitutions are described in the second aspect of the invention.

In an embodiment, the polypeptide of the twenty-fifth aspect comprises the motif [H/Y][L/M]F[F/S][A/C/H/S/T/V][A/D/G/N/R]D[D/E/N]G (SEQ ID NO: 1), preferably the motif [H/Y]LF[F/S][A/S/V][A/D/G]DNG (SEQ ID NO: 2), more preferable the motif YLFF[A/V][A/G]DNG (SEQ ID NO: 3), or even more preferably the motif YLFFAGDNG (SEQ ID NO: 4).

Polypeptides Having Xylanase Activity

In a twenty-sixth aspect, the invention relates to polypeptides having xylanase activity and having a sequence identity to the mature polypeptide of SEQ ID NO: 83 of at least 84%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, which have xylanase activity. In one embodiment, the polypeptides differ by up to 48 amino acids, e.g., between 1 and 48 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47 or 48 amino acids from the mature polypeptide of SEQ ID NO: 83.

In a continuation of the twenty-sixth aspect, the invention further relates to polypeptides having a sequence identity to SEQ ID NO: 84 of at least 84% which have xylanase activity. In an embodiment, the polypeptide has a sequence identity to SEQ ID NO: 84 of at least 85%. In an embodiment, the polypeptide has a sequence identity to SEQ ID NO: 84 of at least 86%. In an embodiment, the polypeptide has a sequence identity to SEQ ID NO: 84 of at least 87%. In an embodiment, the polypeptide has a sequence identity to SEQ ID NO: 84 of at least 88%. In an embodiment, the polypeptide has a sequence identity to SEQ ID NO: 84 of at least 89%. In an embodiment, the polypeptide has a sequence identity to SEQ ID NO: 84 of at least 90%. In an embodiment, the polypeptide has a sequence identity to SEQ ID NO: 84 of at least 91%. In an embodiment, the polypeptide has a sequence identity to SEQ ID NO: 84 of at least 92%. In an embodiment, the polypeptide has a sequence identity to SEQ ID NO: 84 of at least 93%. In an embodiment, the polypeptide has a sequence identity to SEQ ID NO: 84 of at least 94%. In an embodiment, the polypeptide has a sequence identity to SEQ ID NO: 84 of at least 95%. In an embodiment, the polypeptide has a sequence identity to SEQ ID NO: 84 of at least 96%. In an embodiment, the polypeptide has a sequence identity to SEQ ID NO: 84 of at least 97%. In an embodiment, the polypeptide has a sequence identity to SEQ ID NO: 84 of at least 98%. In an embodiment, the polypeptide has a sequence identity to SEQ ID NO: 84 of at least 99%.

In one embodiment, the polypeptides differ by up to 48 amino acids, e.g., between 1 and 48 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47 or 48 amino acids from SEQ ID NO: 84. In one embodiment, the polypeptides differ by up to 48 amino acids, e.g., between 1 and 48 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47 or 48 amino acids from SEQ ID NO: 87. In an embodiment, the polypeptide has at least 60%, at least 70%, at least 75%, at least 80%, at least 85%, at least 90%, at least 95%, or at least 100% of the activity of the polypeptide of SEQ ID NO: 84.

In one embodiment, the polypeptide preferably comprises or consists of the amino acid sequence of SEQ ID NO: 83 and/or SEQ ID NO: 84 or an allelic variant thereof; comprises the amino acid sequence of SEQ ID NO: 84 and a N-terminal and/or C-terminal His-tag and/or HQ-tag such as SEQ ID NO: 86 and/or SEQ ID NO: 87; or is a fragment thereof having xylanase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of the mature polypeptide of SEQ ID NO: 83. In another embodiment, the polypeptide comprises or consists of the mature polypeptide of SEQ ID NO: 86. In another embodiment, the polypeptide comprises or consists of amino acids 1 to 299 of SEQ ID NO: 83. In another embodiment, the polypeptide comprises or consists of amino acids 1 to 299 of SEQ ID NO: 84. In another embodiment, the polypeptide comprises or consists of amino acids 1 to 307 of SEQ ID NO: 86. In another embodiment, the polypeptide comprises or consists of amino acids 1 to 307 of SEQ ID NO: 87. In an embodiment, the polypeptide has been isolated.

In a continuation of the twenty-sixth aspect, the invention relates to a polypeptide having xylanase activity encoded by a polynucleotide that hybridizes under high stringency conditions or very high stringency conditions with (i) the mature polypeptide coding sequence of SEQ ID NO: 82 or (ii) the full-length complement of (i). In an embodiment, the polypeptide has been isolated.

In a continuation of the twenty-sixth aspect, the invention relates to a polypeptide having xylanase activity encoded by a polynucleotide having a sequence identity to the mature polypeptide coding sequence of SEQ ID NO: 82 or the cDNA sequence thereof of at least 84%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. In a further embodiment, the polypeptide has been isolated.

In a continuation of the twenty-sixth aspect, the invention relates to variants of SEQ ID NO: 84 having xylanase activity comprising one or more amino acid substitutions, and/or one or more amino acid deletions, and/or one or more amino acid insertions or any combination thereof at one or more (e.g., several) positions. In an embodiment, the number of positions comprising one or more amino acid substitutions, and/or one or more amino acid deletions, and/or one or more amino acid insertions or any combination thereof in SEQ ID NO: 84 is not more than 48, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47 or 48. In another embodiment, the number of positions comprising one or more amino acid substitutions, and/or one or more amino acid deletions, and/or one or more amino acid insertions or any combination thereof in SEQ ID NO: 84 is between 1 and 48, such as 1-45, 1-40, 1-35, 1-30, 1-25, 1-20, 1-15, 1-10 or 1-5 positions. In an embodiment, the number of positions comprising one or more amino acid substitutions, and/or one or more amino acid deletions, and/or one or more amino acid insertions or any combination thereof in SEQ ID NO: 84 is not more than 10, e.g., 1, 2, 3, 4, 5, 6, 7, 8, 9 or 10. In another embodiment, the number of substitutions, deletions, and/or insertions in SEQ ID NO: 84 is not more than 10, e.g., 1, 2, 3, 4, 5, 6, 7, 8, 9 or 10. In a further embodiment, the number of substitutions, preferably conservative substitutions, in SEQ ID NO: 84 is not more than 10, e.g., 1, 2, 3, 4, 5, 6, 7, 8, 9 or 10. In an embodiment, the variant has at least 60%, at least 70%, at least 75%, at least 80%, at least 85%, at least 90%, at least 95%, or at least 100% of the activity of the polypeptide of SEQ ID NO: 84. Examples of amino acid changes and conservative substitutions are described in the second aspect of the invention.

In a twenty-seventh aspect, the invention relates to polypeptides having xylanase activity and having a sequence identity to the mature polypeptide of SEQ ID NO: 98 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, which have xylanase activity. In one embodiment, the polypeptides differ by up to 40 amino acids, e.g., between 1 and 40 amino acids, such as 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39 or 40 amino acids from the mature polypeptide of SEQ ID NO: 98.

In a continuation of the twenty-seventh aspect, the invention further relates to polypeptides having a sequence identity to SEQ ID NO: 99 of at least 80% which have xylanase activity. In an embodiment, the polypeptide has a sequence identity to SEQ ID NO: 99 of at least 85%. In an embodiment, the polypeptide has a sequence identity to SEQ ID NO: 99 of at least 86%. In an embodiment, the polypeptide has a sequence identity to SEQ ID NO: 99 of at least 87%. In an embodiment, the polypeptide has a sequence identity to SEQ ID NO: 99 of at least 88%. In an embodiment, the polypeptide has a sequence identity to SEQ ID NO: 99 of at least 89%. In an embodiment, the polypeptide has a sequence identity to SEQ ID NO: 99 of at least 90%. In an embodiment, the polypeptide has a sequence identity to SEQ ID NO: 99 of at least 91%. In an embodiment, the polypeptide has a sequence identity to SEQ ID NO: 99 of at least 92%. In an embodiment, the polypeptide has a sequence identity to SEQ ID NO: 99 of at least 93%. In an embodiment, the polypeptide has a sequence identity to SEQ ID NO: 99 of at least 94%. In an embodiment, the polypeptide has a sequence identity to SEQ ID NO: 99 of at least 95%. In an embodiment, the polypeptide has a sequence identity to SEQ ID NO: 99 of at least 96%. In an embodiment, the polypeptide has a sequence identity to SEQ ID NO: 99 of at least 97%. In an embodiment, the polypeptide has a sequence identity to SEQ ID NO: 99 of at least 98%. In an embodiment, the polypeptide has a sequence identity to SEQ ID NO: 99 of at least 99%.

In one embodiment, the polypeptides differ by up to 40 amino acids, e.g., between 1 and 40 amino acids, such as 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39 or 40 amino acids from SEQ ID NO: 99. In an embodiment, the polypeptide has at least 60%, at least 70%, at least 75%, at least 80%, at least 85%, at least 90%, at least 95%, or at least 100% of the activity of the polypeptide of SEQ ID NO: 99.

In one embodiment, the polypeptide preferably comprises or consists of the amino acid sequence of SEQ ID NO: 98 and/or SEQ ID NO: 99 or an allelic variant thereof; comprises the amino acid sequence of SEQ ID NO: 99 and a N-terminal and/or C-terminal His-tag and/or HQ-tag; or is a fragment thereof having xylanase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of the mature polypeptide of SEQ ID NO: 98. In another embodiment, the polypeptide comprises or consists of amino acids 1 to 203 of SEQ ID NO: 98. In another embodiment, the polypeptide comprises or consists of amino acids 1 to 203 of SEQ ID NO: 99. In an embodiment, the polypeptide has been isolated.

In a continuation of the twenty-seventh aspect, the invention relates to a polypeptide having xylanase activity encoded by a polynucleotide that hybridizes under high stringency conditions or very high stringency conditions with (i) the mature polypeptide coding sequence of SEQ ID NO: 97 or (ii) the full-length complement of (i). In an embodiment, the polypeptide has been isolated.

In a continuation of the twenty-seventh aspect, the invention relates to a polypeptide having xylanase activity encoded by a polynucleotide having a sequence identity to the mature polypeptide coding sequence of SEQ ID NO: 97 or the cDNA sequence thereof of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. In a further embodiment, the polypeptide has been isolated.

In a continuation of the twenty-seventh aspect, the invention relates to variants of SEQ ID NO: 99 having xylanase activity comprising one or more amino acid substitutions, and/or one or more amino acid deletions, and/or one or more amino acid insertions or any combination thereof at one or more (e.g., several) positions. In an embodiment, the number of positions comprising one or more amino acid substitutions, and/or one or more amino acid deletions, and/or one or more amino acid insertions or any combination thereof in SEQ ID NO: 99 is not more than 40, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39 or 40. In another embodiment, the number of positions comprising one or more amino acid substitutions, and/or one or more amino acid deletions, and/or one or more amino acid insertions or any combination thereof in SEQ ID NO: 99 is between 1 and 48, such as 1-45, 1-40, 1-35, 1-30, 1-25, 1-20, 1-15, 1-10 or 1-5 positions. In an embodiment, the number of positions comprising one or more amino acid substitutions, and/or one or more amino acid deletions, and/or one or more amino acid insertions or any combination thereof in SEQ ID NO: 99 is not more than 10, e.g., 1, 2, 3, 4, 5, 6, 7, 8, 9 or 10. In another embodiment, the number of substitutions, deletions, and/or insertions in SEQ ID NO: 99 is not more than 10, e.g., 1, 2, 3, 4, 5, 6, 7, 8, 9 or 10. In a further embodiment, the number of substitutions, preferably conservative substitutions, in SEQ ID NO: 99 is not more than 10, e.g., 1, 2, 3, 4, 5, 6, 7, 8, 9 or 10. In an embodiment, the variant has at least 60%, at least 70%, at least 75%, at least 80%, at least 85%, at least 90%, at least 95%, or at least 100% of the activity of the polypeptide of SEQ ID NO: 99. Examples of amino acid changes and conservative substitutions are described in the second aspect of the invention.

In a twenty-eighth aspect, the invention relates to polypeptides having xylanase activity and having a sequence identity to the mature polypeptide of SEQ ID NO: 101 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, which have xylanase activity. In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 amino acids from the mature polypeptide of SEQ ID NO: 101.

In a continuation of the twenty-eighth aspect, the invention further relates to polypeptides having a sequence identity to SEQ ID NO: 102 of at least 80% which have xylanase activity. In an embodiment, the polypeptide has a sequence identity to SEQ ID NO: 102 of at least 85%. In an embodiment, the polypeptide has a sequence identity to SEQ ID NO: 102 of at least 86%. In an embodiment, the polypeptide has a sequence identity to SEQ ID NO: 102 of at least 87%. In an embodiment, the polypeptide has a sequence identity to SEQ ID NO: 102 of at least 88%. In an embodiment, the polypeptide has a sequence identity to SEQ ID NO: 102 of at least 89%. In an embodiment, the polypeptide has a sequence identity to SEQ ID NO: 102 of at least 90%. In an embodiment, the polypeptide has a sequence identity to SEQ ID NO: 102 of at least 91%. In an embodiment, the polypeptide has a sequence identity to SEQ ID NO: 102 of at least 92%. In an embodiment, the polypeptide has a sequence identity to SEQ ID NO: 102 of at least 93%. In an embodiment, the polypeptide has a sequence identity to SEQ ID NO: 102 of at least 94%. In an embodiment, the polypeptide has a sequence identity to SEQ ID NO: 102 of at least 95%. In an embodiment, the polypeptide has a sequence identity to SEQ ID NO: 102 of at least 96%. In an embodiment, the polypeptide has a sequence identity to SEQ ID NO: 102 of at least 97%. In an embodiment, the polypeptide has a sequence identity to SEQ ID NO: 102 of at least 98%. In an embodiment, the polypeptide has a sequence identity to SEQ ID NO: 102 of at least 99%.

In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 amino acids from SEQ ID NO: 102. In an embodiment, the polypeptide has at least 60%, at least 70%, at least 75%, at least 80%, at least 85%, at least 90%, at least 95%, or at least 100% of the activity of the polypeptide of SEQ ID NO: 102.

In one embodiment, the polypeptide preferably comprises or consists of the amino acid sequence of SEQ ID NO: 101 and/or SEQ ID NO: 102 or an allelic variant thereof; comprises the amino acid sequence of SEQ ID NO: 102 and a N-terminal and/or C-terminal His-tag and/or HQ-tag; or is a fragment thereof having xylanase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of the mature polypeptide of SEQ ID NO: 101. In another embodiment, the polypeptide comprises or consists of amino acids 1 to 203 of SEQ ID NO: 101. In another embodiment, the polypeptide comprises or consists of amino acids 1 to 203 of SEQ ID NO: 102. In an embodiment, the polypeptide has been isolated.

In a continuation of the twenty-eighth aspect, the invention relates to a polypeptide having xylanase activity encoded by a polynucleotide that hybridizes under high stringency conditions or very high stringency conditions with (i) the mature polypeptide coding sequence of SEQ ID NO: 100 or (ii) the full-length complement of (i). In an embodiment, the polypeptide has been isolated.

In a continuation of the twenty-eighth aspect, the invention relates to a polypeptide having xylanase activity encoded by a polynucleotide having a sequence identity to the mature polypeptide coding sequence of SEQ ID NO: 100 or the cDNA sequence thereof of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. In a further embodiment, the polypeptide has been isolated.

In a continuation of the twenty-eighth aspect, the invention relates to variants of SEQ ID NO: 102 having xylanase activity comprising one or more amino acid substitutions, and/or one or more amino acid deletions, and/or one or more amino acid insertions or any combination thereof at one or more (e.g., several) positions. In an embodiment, the number of positions comprising one or more amino acid substitutions, and/or one or more amino acid deletions, and/or one or more amino acid insertions or any combination thereof in SEQ ID NO: 102 is not more than 40, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50. In another embodiment, the number of positions comprising one or more amino acid substitutions, and/or one or more amino acid deletions, and/or one or more amino acid insertions or any combination thereof in SEQ ID NO: 102 is between 1 and 48, such as 1-45, 1-40, 1-35, 1-30, 1-25, 1-20, 1-15, 1-10 or 1-5 positions. In an embodiment, the number of positions comprising one or more amino acid substitutions, and/or one or more amino acid deletions, and/or one or more amino acid insertions or any combination thereof in SEQ ID NO: 102 is not more than 10, e.g., 1, 2, 3, 4, 5, 6, 7, 8, 9 or 10. In another embodiment, the number of substitutions, deletions, and/or insertions in SEQ ID NO: 102 is not more than 10, e.g., 1, 2, 3, 4, 5, 6, 7, 8, 9 or 10. In a further embodiment, the number of substitutions, preferably conservative substitutions, in SEQ ID NO: 102 is not more than 10, e.g., 1, 2, 3, 4, 5, 6, 7, 8, 9 or 10. In an embodiment, the variant has at least 60%, at least 70%, at least 75%, at least 80%, at least 85%, at least 90%, at least 95%, or at least 100% of the activity of the polypeptide of SEQ ID NO: 102. Examples of amino acid changes and conservative substitutions are described in the second aspect of the invention.

Sources of Polypeptides Having Arabinofuranosidase or Xylanase Activity

A polypeptide having arabinofuranosidase or xylanase activity of the present invention may be obtained from microorganisms of any genus. For purposes of the present invention, the term "obtained from" as used herein in connection with a given source shall mean that the polypeptide encoded by a polynucleotide is produced by the source or by a strain in which the polynucleotide from the source has been inserted. In one aspect, the polypeptide obtained from a given source is secreted extracellularly.

The polypeptide may be a fungal polypeptide. In one embodiment, the polypeptide is from a fungus of the order Eurotiales, or from the family Aspergillaceae, or from the genus *Penicillium* or from the species *Penicillium aurantiogriseum, Penicillium oxalicum, Penicillium capsulatum* or *Penicillium soppii*.

In one embodiment, the polypeptide is from a fungus of the order Eurotiales, or from the family Aspergillaceae, or from the genus *Aspergillus* or from the species *Aspergillus clavatus, Aspergillus wentii, Aspergillus aculeatus* or *Aspergillus fumigatiaffinis*.

In one embodiment, the polypeptide is from a fungus of the order Eurotiales, or from the family Aspergillaceae, or from the genus *Neosartorya* or from the species *Neosartorya fischeri*.

In one embodiment, the polypeptide is from a fungus of the order Eurotiales, or from the family Trichocomaceae, or from the genus *Talaromyces* or from the species *Talaromyces pinophilus*.

In one embodiment, the polypeptide is from a fungus of the order Ustilaginales, or from the family Ustilaginaceae, or from the genus *Ustilago* or from the species *Ustilago maydis*.

In one embodiment, the polypeptide is from a fungus of the phylum Ascomycota, or from the genus *Acrophialophora* or from the species *Acrophialophora fusispora*.

The polypeptide may be a bacterial polypeptide. In one embodiment, the polypeptide is from a *bacterium* of the order Actinomycetales, or from the family Streptomycetaceae, or from the genus *Streptomyces* or from the species *Streptomyces nitrosporeus* or *Streptomyces beijiangensis*.

In one embodiment, the polypeptide is from a *bacterium* of the order Actinomycetales, or from the family Streptosporangiaceae, or from the genus *Streptosporangium* or from the species *Streptosporangium* sp-60756.

In one embodiment, the polypeptide is from a fungus of the order Botryosphaeriales, or from the family Botryosphaeriaceae, or from the genus *Lasiodiplodia* or from the species *Lasiodiplodia theobromae*.

In one embodiment, the polypeptide is from a fungus of the order Pezizales, or from the family Ascobolaceae, or from the genus *Ascobolus* or from the species *Ascobolus stictoideus*.

In one embodiment, the polypeptide is from a fungus of the order Pleosporales, or from the family Pleosporaceae, or from the genus *Drechslera* or from the species *Drechslera* sp.

In one embodiment, the polypeptide is from a *bacterium* of the order Micrococcales, or from the family Promicromonosporaceae, or from the genus *Xylanibacterium* or from the species *Xylanibacterium* sp-61981.

In one embodiment, the polypeptide is from a fungus of the order Xylariales, or from the family Microdochiaceae, or from the genus *Microdochium* or from the species *Microdochium nivale*.

In one embodiment, the polypeptide is from a fungus of the order Sordariales, or from the family Chaetomiaceae, or from the genus *Humicola* or from the species *Humicola hyalothermophila* or *Humicola* sp.

In one embodiment, the polypeptide is from a fungus of the order Pleosporales, or from the family Pleosporaceae, or from the genus *Curvularia* or from the species *Curvularia geniculata*.

In one embodiment, the polypeptide is from a *bacterium* of the order Glycomycetales, or from the family Glycomycetaceae, or from the genus *Glycomyces* or from the species *Glycomyces rutgersensis*.

In one embodiment, the polypeptide is from a fungus of the order Sordariales, or from the genus *Remersonia* or from the species *Remersonia thermophile*.

In one embodiment, the polypeptide is from a fungus of the order Sordariales, or from the family Chaetomiaceae, or from the genus *Thielavia* or from the species *Thielavia arenaria* or *Thielavia terricola*.

In one embodiment, the polypeptide is from a fungus of the order Sordariales, or from the family Chaetomiaceae, or from the genus *Chaetomium* or from the species *Chaetomium olivicolor*.

It will be understood that for the aforementioned species, the invention encompasses both the perfect and imperfect states, and other taxonomic equivalents, e.g., anamorphs, regardless of the species name by which they are known. Those skilled in the art will readily recognize the identity of appropriate equivalents.

Strains of these species are readily accessible to the public in a number of culture collections, such as the American Type Culture Collection (ATCC), Deutsche Sammlung von Mikroorganismen and Zellkulturen GmbH (DSMZ), Centraalbureau Voor Schimmelcultures (CBS), and Agricultural Research Service Patent Culture Collection, Northern Regional Research Center (NRRL).

The polypeptide may be identified and obtained from other sources including microorganisms isolated from nature (e.g., soil, composts, water, etc.) or DNA samples obtained directly from natural materials (e.g., soil, composts, water, etc.) using the above-mentioned probes. Techniques for isolating microorganisms and DNA directly from natural habitats are well known in the art. A polynucleotide encoding the polypeptide may then be obtained by similarly screening a genomic DNA or cDNA library of another microorganism or mixed DNA sample. Once a polynucleotide encoding a polypeptide has been detected with the probe(s), the polynucleotide can be isolated or cloned by utilizing techniques that are known to those of ordinary skill in the art (see, e.g., Sambrook et al., 1989, supra).

Methods of Improving Animal Performance

In a twenty-ninth aspect, the invention relates to a method of improving one or more performance parameters of an animal comprising administering to one or more animals the composition of the first aspect of the invention or any embodiment of the first aspect of the invention herein defined, such as in the section related to 'GH62 Polypeptides of the Composition', or the section related to 'GH10 and GH11 Polypeptides of the Composition' or the section on 'Combinations' or as described in any of the second to the twenty-eighth aspect of the invention. In an embodiment, the performance parameter is selected from the list consisting of body weight gain, European Production Efficiency Factor (EPEF), European Production Efficacy Factor (EFF) and FCR.

The twenty-ninth aspect of the invention also relates to a method of improving one or more performance parameters of an animal comprising administering to one or more animals an animal feed additive comprising the composition of the first aspect of the invention or any embodiment of the first aspect of the invention herein defined (such as in the section related to 'GH62 Polypeptides of the Composition', or the section related to 'GH10 and GH11 Polypeptides of the Composition' or the section on 'Combinations' or as described in any of the second to the twenty-eighth aspect of the invention) and one or more formulating agents. In an embodiment, the performance parameter is selected from the list consisting of body weight gain, European Production Efficiency Factor (EPEF), European Production Efficacy Factor (EFF) and FCR. In a further embodiment, the animal feed additive comprises one or more components selected from the list consisting of one or more additional enzymes, one or more microbes, one or more vitamins, one or more minerals, one or more amino acids, one or more other feed ingredients or any combination thereof.

The twenty-ninth aspect of the invention further relates to a method of improving one or more performance parameters of an animal comprising administering to one or more animals an animal feed comprising the composition of the first aspect of the invention or any embodiment of the first aspect of the invention herein defined (such as in the section related to 'GH62 Polypeptides of the Composition', or the section related to 'GH10 and GH11 Polypeptides of the Composition' or the section on 'Combinations' or as described in any of the second to the twenty-eighth aspect of the invention), one or more formulating agents and plant based material from the sub-family Panicoideae. In an embodiment, the performance parameter is selected from the list consisting of body weight gain, European Production Efficiency Factor (EPEF), European Production Efficacy Factor (EFF) and FCR. In a further embodiment, the animal feed additive comprises one or more components selected from the list consisting of one or more additional enzymes, one or more microbes, one or more vitamins, one or more minerals, one or more amino acids, one or more other feed ingredients or any combination thereof.

The twenty-ninth aspect of the invention also relates to a method of improving one or more performance parameters of an animal comprising administering to one or more animals an animal feed additive comprising a polypeptide having xylanase activity and having at least 80% sequence identity, e.g., at least 85%, at least 86%, at least 87%, at least 88%, at least 89%, at least 90%, at least 91%, at least 92%, at least 93%, at least 94%, at least 95%, at least 96%, at least 97%, at least 98% or at least 99% to the polypeptide of SEQ ID NO: 71. In one embodiment, the polypeptides differ by up to 25 amino acids, e.g., between 1 and 25 amino acids, such as 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24 or 25 amino acids from SEQ ID NO: 71. In one embodiment, the polypeptide comprises or consists of the amino acid sequence of SEQ ID NO: 71; or is a fragment thereof having xylanase activity and having at least 90% such as at least 91%, at least 92%, at least 93%, at least 94%, at least 95%, at least 96%, at least 97%, at least 98% or at least 99% of the length of the polypeptide. In another embodiment, polypeptide comprises or consists of amino acids 1 to 288 of SEQ ID NO: 71.

The twenty-ninth aspect of the invention also relates to a method of improving one or more performance parameters of an animal comprising administering to one or more animals an animal feed additive comprising a polypeptide having xylanase activity and having at least 80% sequence identity, e.g., at least 85%, at least 86%, at least 87%, at least 88%, at least 89%, at least 90%, at least 91%, at least 92%, at least 93%, at least 94%, at least 95%, at least 96%, at least 97%, at least 98% or at least 99% to the polypeptide of SEQ ID NO: 78. In one embodiment, the polypeptides differ by up to 25 amino acids, e.g., between 1 and 25 amino acids, such as 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24 or 25 amino acids from SEQ ID NO: 78. In one embodiment, the polypeptide comprises or consists of the amino acid sequence of SEQ ID NO: 78; or is a fragment thereof having xylanase activity and having at least 90% such as at least 91%, at least 92%, at least 93%, at least 94%, at least 95%, at least 96%, at least 97%, at least 98% or at least 99% of the length of the polypeptide. In another embodiment, polypeptide comprises or consists of amino acids 1 to 181 of SEQ ID NO: 78.

The twenty-ninth aspect of the invention also relates to a method of improving one or more performance parameters of an animal comprising administering to one or more animals an animal feed additive comprising a polypeptide having xylanase activity and having at least 80% sequence identity, e.g., at least 85%, at least 86%, at least 87%, at least 88%, at least 89%, at least 90%, at least 91%, at least 92%, at least 93%, at least 94%, at least 95%, at least 96%, at least 97%, at least 98% or at least 99% to the polypeptide of SEQ ID NO: 177. In one embodiment, the polypeptides differ by up to 25 amino acids, e.g., between 1 and 25 amino acids, such as 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24 or 25 amino acids from SEQ ID NO: 177. In one embodiment, the polypeptide comprises or consists of the amino acid sequence of SEQ ID NO: 177; or is a fragment thereof having xylanase activity and having at least 90% such as at least 91%, at least 92%, at least 93%, at least 94%, at least 95%, at least 96%, at least 97%, at least 98% or at least 99% of the length of the polypeptide. In another embodiment, polypeptide comprises or consists of amino acids 1 to 323 of SEQ ID NO: 177.

In an embodiment, the plant based material from the sub-family Panicoideae is maize, corn, sorghum, switchgrass, millet, pearl millet, foxtail millet or in a processed form such as milled corn, milled maize, defatted maize, defatted destarched maize, milled sorghum, milled switchgrass, milled millet, milled foxtail millet, milled pearl millet, or any combination thereof. In a further embodiment, the plant based material from the sub-family Panicoideae is from the seed fraction (such as endosperm and/or husk) of the plant.

Methods of Solubilising Xylose

In a thirtieth aspect, the invention relates to a method of solubilising xylose from plant based material, comprising treating plant based material from the sub-family Panicoideae with the composition of the first aspect of the invention or any embodiment of the first aspect of the invention herein defined, such as in the section related to 'GH62 Polypeptides of the Composition', or the section related to 'GH10 and GH11 Polypeptides of the Composition' or the section on 'Combinations' or as described in any of the second to the twenty-eighth aspect of the invention. In an embodiment, the plant based material from the sub-family Panicoideae is maize, corn, sorghum, switchgrass, millet, pearl millet, foxtail millet or in a processed form such as milled corn, milled maize, defatted maize, defatted destarched maize, milled sorghum, milled switchgrass, milled millet, milled foxtail millet, milled pearl millet, or any combination thereof. In a further embodiment, the plant based material from the sub-family Panicoideae is from the seed fraction (such as endosperm and/or husk) of the plant.

The thirtieth aspect of the invention also relates to a method of solubilising xylose from plant based material, comprising treating plant based material from the sub-family Panicoideae with the composition of the first aspect of the invention or any embodiment herein defined (such as in the section related to 'GH62 Polypeptides of the Composition', or the section related to 'GH10 and GH11 Polypeptides of the Composition' or the section on 'Combinations' or as described in any of the second to the twenty-eighth aspect of the invention) and one or more formulating agents. In a further embodiment, the plant based material from the sub-family Panicoideae is maize, corn, sorghum, switchgrass, millet, pearl millet, foxtail millet or in a processed form such as milled corn, milled maize, defatted maize, defatted destarched maize, milled sorghum, milled switchgrass, milled millet, milled foxtail millet, milled pearl millet, or any combination thereof. In a further embodiment, the plant based material from the sub-family Panicoideae is from the seed fraction (such as endosperm and/or husk) of the plant.

The thirtieth aspect of the invention further relates to a method of solubilising xylose from plant based material, comprising treating plant based material from the sub-family Panicoideae with an animal feed additive of the first aspect of the invention or any embodiment herein defined (such as in the section related to 'GH62 Polypeptides of the Composition', or the section related to 'GH10 and GH11 Polypeptides of the Composition' or the section on 'Combinations' or as described in any of the second to the twenty-eighth aspect of the invention) and one or more formulating agents. In a further embodiment, the plant based material from the sub-family Panicoideae is maize, corn, sorghum, switchgrass, millet, pearl millet, foxtail millet or in a processed form such as milled corn, milled maize, defatted maize, defatted destarched maize, milled sorghum, milled switchgrass, milled millet, milled foxtail millet, milled pearl millet, or any combination thereof. In a further embodiment, the plant based material from the sub-family Panicoideae is from the seed fraction (such as endosperm and/or husk) of the plant.

The thirtieth aspect of the invention further relates to a method of solubilising xylose from plant based material, comprising treating plant based material from the sub-family Panicoideae with an animal feed additive comprising a polypeptide having xylanase activity and having at least 80% sequence identity, e.g., at least 85%, at least 86%, at least 87%, at least 88%, at least 89%, at least 90%, at least 91%, at least 92%, at least 93%, at least 94%, at least 95%, at least 96%, at least 97%, at least 98% or at least 99% to the polypeptide of SEQ ID NO: 71. In one embodiment, the polypeptides differ by up to 25 amino acids, e.g., between 1 and 25 amino acids, such as 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24 or 25 amino acids from SEQ ID NO: 71. In one embodiment, the polypeptide comprises or consists of the amino acid sequence of SEQ ID NO: 71; or is a fragment thereof having xylanase activity and having at least 90% such as at least 91%, at least 92%, at least 93%, at least 94%, at least 95%, at least 96%, at least 97%, at least 98% or at least 99% of the length of the polypeptide. In another embodiment, polypeptide comprises or consists of amino acids 1 to 288 of SEQ ID NO: 71.

The thirtieth aspect of the invention further relates to a method of solubilising xylose from plant based material, comprising treating plant based material from the sub-family Panicoideae with an animal feed additive comprising a polypeptide having xylanase activity and having at least 80% sequence identity, e.g., at least 85%, at least 86%, at least 87%, at least 88%, at least 89%, at least 90%, at least 91%, at least 92%, at least 93%, at least 94%, at least 95%, at least 96%, at least 97%, at least 98% or at least 99% to the polypeptide of SEQ ID NO: 78. In one embodiment, the polypeptides differ by up to 25 amino acids, e.g., between 1 and 25 amino acids, such as 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24 or 25 amino acids from SEQ ID NO: 78. In one embodiment, the polypeptide comprises or consists of the amino acid sequence of SEQ ID NO: 78; or is a fragment thereof having xylanase activity and having at least 90% such as at least 91%, at least 92%, at least 93%, at least 94%, at least 95%, at least 96%, at least 97%, at least 98% or at least 99% of the length of the polypeptide. In another embodiment, polypeptide comprises or consists of amino acids 1 to 181 of SEQ ID NO: 78.

The thirtieth aspect of the invention further relates to a method of solubilising xylose from plant based material, comprising treating plant based material from the sub-family Panicoideae with an animal feed additive comprising a polypeptide having xylanase activity and having at least 80% sequence identity, e.g., at least 85%, at least 86%, at least 87%, at least 88%, at least 89%, at least 90%, at least 91%, at least 92%, at least 93%, at least 94%, at least 95%, at least 96%, at least 97%, at least 98% or at least 99% to the polypeptide of SEQ ID NO: 177. In one embodiment, the polypeptides differ by up to 25 amino acids, e.g., between 1 and 25 amino acids, such as 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24 or 25 amino acids from SEQ ID NO: 177. In one embodiment, the polypeptide comprises or consists of the amino acid sequence of SEQ ID NO: 177; or is a fragment thereof having xylanase activity and having at least 90% such as at least 91%, at least 92%, at least 93%, at least 94%, at least 95%, at least 96%, at least 97%, at least 98% or at least 99% of the length of the polypeptide. In another embodiment, polypeptide comprises or consists of amino acids 1 to 323 of SEQ ID NO: 177.

Methods of Releasing Starch

In a thirty-first aspect, the invention relates to a method of releasing starch from plant based material, comprising treating plant based material from the sub-family Panicoideae with the composition of the first aspect of the invention or any embodiment of the first aspect of the invention herein defined, such as in the section related to 'GH62 Polypeptides of the Composition', or the section related to 'GH10 and GH11 Polypeptides of the Composition' or the section on 'Combinations' or as described in any of the second to the twenty-eighth aspect of the invention. In an embodiment, the plant based material from the sub-family Panicoideae is maize, corn, sorghum, switchgrass, millet, pearl millet, foxtail millet or in a processed form such as milled corn, milled maize, defatted maize, defatted destarched maize, milled sorghum, milled switchgrass, milled millet, milled foxtail millet, milled pearl millet, or any combination thereof. In a further embodiment, the plant based material from the sub-family Panicoideae is from the seed fraction (such as endosperm and/or husk) of the plant.

The thirty-first aspect of the invention also relates to a method of releasing starch from plant based material, comprising treating plant based material from the sub-family Panicoideae with the composition of the first aspect of the invention or any embodiment herein defined (such as in the section related to 'GH62 Polypeptides of the Composition', or the section related to 'GH10 and GH11 Polypeptides of the Composition' or the section on 'Combinations' or as described in any of the second to the twenty-eighth aspect of the invention) and one or more formulating agents. In a further embodiment, the plant based material from the sub-family Panicoideae is maize, corn, sorghum, switchgrass, millet, pearl millet, foxtail millet or in a processed form such as milled corn, milled maize, defatted maize, defatted destarched maize, milled sorghum, milled switchgrass, milled millet, milled foxtail millet, milled pearl millet, or any combination thereof. In a further embodiment, the plant based material from the sub-family Panicoideae is from the seed fraction (such as endosperm and/or husk) of the plant.

The thirty-first aspect of the invention further relates to a method of releasing starch from plant based material, comprising treating plant based material from the sub-family Panicoideae with an animal feed additive of the first aspect of the invention or any embodiment herein defined (such as in the section related to 'GH62 Polypeptides of the Composition', or the section related to 'GH10 and GH11 Polypeptides of the Composition' or the section on 'Combinations' or as described in any of the second to the twenty-eighth aspect of the invention) and one or more formulating agents. In a further embodiment, the plant based material from the sub-family Panicoideae is maize, corn, sorghum, switchgrass, millet, pearl millet, foxtail millet or in a processed form such as milled corn, milled maize, defatted maize, defatted destarched maize, milled sorghum, milled switchgrass, milled millet, milled foxtail millet, milled pearl millet, or any combination thereof. In a further embodiment, the plant based material from the sub-family Panicoideae is from the seed fraction (such as endosperm and/or husk) of the plant.

Methods for Improving the Nutritional Value of an Animal Feed

The term improving the nutritional value of an animal feed means improving the availability of nutrients in the feed. In this invention improving the nutritional values refers in particular to improving the solubilisation and degradation of the arabinoxylan-containing fraction (e.g. such as hemicellulose) of the feed, thereby leading to increased release of nutrients from cells in the endosperm that have cell walls composed of highly recalcitrant hemicellulose. Consequently, an improved arabinose and/or xylose extraction indicates a disruption of the cell walls and as a result the nutritional value of the feed is improved resulting in increased growth rate and/or weight gain and/or feed conversion (i.e. the weight of ingested feed relative to weight gain). In addition the arabinose and/or xylose release may result in improved utilization of these components per se either directly or by bacterial fermentation in the hind gut thereby resulting in a production of short chain fatty acids that may be readily absorbed in the hind and utilised in the energy metabolism.

In a thirty-second aspect, the invention relates to a method for improving the nutritional value of an animal feed comprising treating the animal feed comprising plant based material from the sub-family Panicoideae with the composition of the first aspect of the invention or any embodiment of the first aspect of the invention herein defined, such as in the section related to 'GH62 Polypeptides of the Composition', or the section related to 'GH10 and GH11 Polypeptides of the Composition' or the section on 'Combinations' or as described in any of the second to the twenty-eighth aspect of the invention. In an embodiment, the plant based material from the sub-family Panicoideae is maize, corn, sorghum, switchgrass, millet, pearl millet, foxtail millet or in a processed form such as milled corn, milled maize, defatted maize, defatted destarched maize, milled sorghum, milled switchgrass, milled millet, milled foxtail millet, milled pearl millet, or any combination thereof. In a further embodiment, the plant based material from the sub-family Panicoideae is from the seed fraction (such as endosperm and/or husk) of the plant.

The thirty-second aspect of the invention also relates to a method for improving the nutritional value of an animal feed comprising treating the animal feed comprising plant based material from the sub-family Panicoideae with a polypeptide having xylanase activity and having at least 80% sequence identity, e.g., at least 85%, at least 86%, at least 87%, at least 88%, at least 89%, at least 90%, at least 91%, at least 92%, at least 93%, at least 94%, at least 95%, at least 96%, at least 97%, at least 98% or at least 99% to the polypeptide of SEQ ID NO: 71. In one embodiment, the polypeptides differ by up to 25 amino acids, e.g., between 1 and 25 amino acids, such as 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24 or 25 amino acids from SEQ ID NO: 71. In one embodiment, the polypeptide comprises or consists of the amino acid sequence of SEQ ID NO: 71; or is a fragment thereof having xylanase activity and having at least 90% such as at least 91%, at least 92%, at least 93%, at least 94%, at least 95%, at least 96%, at least 97%, at least 98% or at least 99% of the length of the polypeptide. In another embodiment, polypeptide comprises or consists of amino acids 1 to 288 of SEQ ID NO: 71.

The thirty-second aspect of the invention also relates to a method for improving the nutritional value of an animal feed comprising treating the animal feed comprising plant based material from the sub-family Panicoideae with a polypeptide having xylanase activity and having at least 80% sequence identity, e.g., at least 85%, at least 86%, at least 87%, at least 88%, at least 89%, at least 90%, at least 91%, at least 92%, at least 93%, at least 94%, at least 95%, at least 96%, at least 97%, at least 98% or at least 99% to the polypeptide of SEQ ID NO: 78. In one embodiment, the polypeptides differ by up to 25 amino acids, e.g., between 1 and 25 amino acids, such as 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24 or 25 amino acids from SEQ ID NO: 78. In one embodiment, the polypeptide comprises or consists of the amino acid sequence of SEQ ID NO: 78; or is a fragment thereof having xylanase activity and having at least 90% such as at least 91%, at least 92%, at least 93%, at least 94%, at least 95%, at least 96%, at least 97%, at least 98% or at least 99% of the length of the polypeptide. In another embodiment, polypeptide comprises or consists of amino acids 1 to 181 of SEQ ID NO: 78.

The thirty-second aspect of the invention also relates to a method for improving the nutritional value of an animal feed comprising treating the animal feed comprising plant based material from the sub-family Panicoideae with a polypeptide having xylanase activity and having at least 80% sequence identity, e.g., at least 85%, at least 86%, at least 87%, at least 88%, at least 89%, at least 90%, at least 91%, at least 92%, at least 93%, at least 94%, at least 95%, at least 96%, at least 97%, at least 98% or at least 99% to the polypeptide of SEQ ID NO: 177. In one embodiment, the polypeptides differ by up to 25 amino acids, e.g., between 1 and 25 amino acids, such as 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24 or 25 amino acids from SEQ ID NO: 177. In one embodiment, the polypeptide comprises or consists of the amino acid sequence of SEQ ID NO: 177; or is a fragment thereof having xylanase activity and having at least 90% such as at least 91%, at least 92%, at least 93%, at least 94%, at least 95%, at least 96%, at least 97%, at least 98% or at least 99% of the length of the polypeptide. In another embodiment, polypeptide comprises or consists of amino acids 1 to 323 of SEQ ID NO: 177.

Methods of Preparing an Animal Feed

In a thirty-third aspect, the invention relates to a method of preparing an animal feed, comprising mixing the composition of the first aspect of the invention or any embodiment herein defined (such as in the section related to 'GH62 Polypeptides of the Composition', or the section related to 'GH10 and GH11 Polypeptides of the Composition' or the section on 'Combinations' or as described in any of the second to the twenty-eighth aspect of the invention) with plant based material from the sub-family Panicoideae, such as maize, corn, sorghum, switchgrass, millet, pearl millet, foxtail millet or in a processed form such as milled corn, milled maize, defatted maize, defatted destarched maize, milled sorghum, milled switchgrass, milled millet, milled foxtail millet, milled pearl millet, or any combination thereof. In a preferred embodiment, the plant based material from the sub-family Panicoideae is from the seed fraction (such as endosperm and/or husk) of the plant, preferable the seed fraction from maize, corn, sorghum, switchgrass, millet, pearl millet, foxtail millet or the processed from thereof, such as milled corn, milled maize, defatted maize, defatted destarched maize, milled sorghum, milled switchgrass, milled millet, milled foxtail millet, milled pearl millet, or any combination thereof. In another preferred embodiment, the plant based material from the sub-family Panicoideae is from a plant part comprising highly branched xylan, such as the seed fraction (such as endosperm and/or husk) of the plant.

Polynucleotides

The present invention also relates to isolated polynucleotides encoding a polypeptide of the present invention.

The techniques used to isolate or clone a polynucleotide are known in the art and include isolation from genomic DNA or cDNA, or a combination thereof. The cloning of the polynucleotides from genomic DNA can be effected, e.g., by using the well-known polymerase chain reaction (PCR) or antibody screening of expression libraries to detect cloned DNA fragments with shared structural features. See, e.g., Innis et al., 1990, *PCR: A Guide to Methods and Application*, Academic Press, New York. Other nucleic acid amplification procedures such as ligase chain reaction (LCR), ligation activated transcription (LAT) and polynucleotide-based amplification (NASBA) may be used. The polynucleotides may be cloned from a strain of *Bacillus*, or a related organism and thus, for example, may be an allelic or species variant of the polypeptide encoding region of the polynucleotide.

The present invention also relates to isolated polynucleotides comprising or consisting of polynucleotides having a degree of sequence identity to the mature polypeptide coding sequence of SEQ ID NO: 10 of at least of at least 85%, e.g., at least 86%, at least 87%, at least 88%, at least 89%, at least 90%, at least 91%, at least 92%, at least 93%, at least 94%, at least 95%, at least 96%, at least 97%, at least 98%, at least 99%, or 100%, which encode a polypeptide having arabinofuranosidase activity.

The present invention also relates to isolated polynucleotides comprising or consisting of polynucleotides having a degree of sequence identity to the mature polypeptide coding sequence of SEQ ID NO: 25 of at least of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% which encode a polypeptide having arabinofuranosidase activity.

The present invention also relates to isolated polynucleotides comprising or consisting of polynucleotides having a degree of sequence identity to the mature polypeptide coding sequence of SEQ ID NO: 28 of at least of at least 90%, e.g., at least 91%, at least 92%, at least 93%, at least 94%, at least 95%, at least 96%, at least 97%, at least 98%, at least 99%, or 100% which encode a polypeptide having arabinofuranosidase activity.

The present invention also relates to isolated polynucleotides comprising or consisting of polynucleotides having a degree of sequence identity to the mature polypeptide coding sequence of SEQ ID NO: 34 of at least of at least 92%, e.g., at least 93%, at least 94%, at least 95%, at least 96%, at least 97%, at least 98%, at least 99%, or 100% which encode a polypeptide having arabinofuranosidase activity.

The present invention also relates to isolated polynucleotides comprising or consisting of polynucleotides having a degree of sequence identity to the mature polypeptide coding sequence of SEQ ID NO: 46 of at least of at least 86%, e.g., at least 87%, at least 88%, at least 89%, at least 90%, at least 91%, at least 92%, at least 93%, at least 94%, at least 95%, at least 96%, at least 97%, at least 98%, at least 99%, or 100% which encode a polypeptide having arabinofuranosidase activity.

The present invention also relates to isolated polynucleotides comprising or consisting of polynucleotides having a degree of sequence identity to the mature polypeptide coding sequence of SEQ ID NO: 52 of at least of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% which encode a polypeptide having arabinofuranosidase activity.

The present invention also relates to isolated polynucleotides comprising or consisting of polynucleotides having a degree of sequence identity to the mature polypeptide coding sequence of SEQ ID NO: 58 of at least of at least 81%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% which encode a polypeptide having arabinofuranosidase activity.

The present invention also relates to isolated polynucleotides comprising or consisting of polynucleotides having a degree of sequence identity to the mature polypeptide coding sequence of SEQ ID NO: 64 of at least of at least 81%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% which encode a polypeptide having arabinofuranosidase activity.

The present invention also relates to isolated polynucleotides comprising or consisting of polynucleotides having a degree of sequence identity to the mature polypeptide coding sequence of SEQ ID NO: 82 of at least of at least 84%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% which encode a polypeptide having xylanase activity.

The present invention also relates to isolated polynucleotides comprising or consisting of polynucleotides having a degree of sequence identity to the mature polypeptide coding sequence of SEQ ID NO: 97 of at least of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% which encode a polypeptide having xylanase activity.

The present invention also relates to isolated polynucleotides comprising or consisting of polynucleotides having a degree of sequence identity to the mature polypeptide coding sequence of SEQ ID NO: 100 of at least of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% which encode a polypeptide having xylanase activity.

The present invention also relates to isolated polynucleotides comprising or consisting of polynucleotides having a degree of sequence identity to the mature polypeptide coding sequence of SEQ ID NO: 103 of at least of at least 87%, e.g., at least 88%, at least 89%, at least 90%, at least 91%, at least 92%, at least 93%, at least 94%, at least 95%, at least 96%, at least 97%, at least 98%, at least 99%, or 100% which encode a polypeptide having arabinofuranosidase activity.

The present invention also relates to isolated polynucleotides comprising or consisting of polynucleotides having a degree of sequence identity to the mature polypeptide coding sequence of SEQ ID NO: 106 of at least of at least 85%, e.g., at least 86%, at least 87%, at least 88%, at least 89%, at least 90%, at least 91%, at least 92%, at least 93%, at least 94%, at least 95%, at least 96%, at least 97%, at least 98%, at least 99%, or 100% which encode a polypeptide having arabinofuranosidase activity.

The present invention also relates to isolated polynucleotides comprising or consisting of polynucleotides having a degree of sequence identity to the mature polypeptide coding sequence of SEQ ID NO: 112 of at least of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% which encode a polypeptide having arabinofuranosidase activity.

The present invention also relates to isolated polynucleotides comprising or consisting of polynucleotides having a degree of sequence identity to the mature polypeptide coding sequence of SEQ ID NO: 118 of at least of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% which encode a polypeptide having arabinofuranosidase activity.

The present invention also relates to isolated polynucleotides comprising or consisting of polynucleotides having a degree of sequence identity to the mature polypeptide coding sequence of SEQ ID NO: 121 of at least of at least 89%, e.g., at least 90%, at least 91%, at least 92%, at least 93%, at least 94%, at least 95%, at least 96%, at least 97%, at least 98%, at least 99%, or 100% which encode a polypeptide having arabinofuranosidase activity.

The present invention also relates to isolated polynucleotides comprising or consisting of polynucleotides having a degree of sequence identity to the mature polypeptide coding sequence of SEQ ID NO: 124 of at least of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% which encode a polypeptide having arabinofuranosidase activity.

The present invention also relates to isolated polynucleotides comprising or consisting of polynucleotides having a degree of sequence identity to the mature polypeptide coding sequence of SEQ ID NO: 136 of at least of at least 84%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% which encode a polypeptide having arabinofuranosidase activity.

The present invention also relates to isolated polynucleotides comprising or consisting of polynucleotides having a degree of sequence identity to the mature polypeptide coding sequence of SEQ ID NO: 139 of at least of at least 89%, e.g., at least 90%, at least 91%, at least 92%, at least 93%, at least 94%, at least 95%, at least 96%, at least 97%, at least 98%, at least 99%, or 100% which encode a polypeptide having arabinofuranosidase activity.

The present invention also relates to isolated polynucleotides comprising or consisting of polynucleotides having a degree of sequence identity to the mature polypeptide coding sequence of SEQ ID NO: 145 of at least of at least 86%, e.g., at least 87%, at least 88%, at least 89%, at least 90%, at least 91%, at least 92%, at least 93%, at least 94%, at least 95%, at least 96%, at least 97%, at least 98%, at least 99%, or 100% which encode a polypeptide having arabinofuranosidase activity.

The present invention also relates to isolated polynucleotides comprising or consisting of polynucleotides having a degree of sequence identity to the mature polypeptide coding sequence of SEQ ID NO: 154 of at least of at least 97%, e.g., at least 98%, at least 99%, or 100% which encode a polypeptide having arabinofuranosidase activity.

The present invention also relates to isolated polynucleotides comprising or consisting of polynucleotides having a degree of sequence identity to the mature polypeptide coding sequence of SEQ ID NO: 157 of at least of at least 97%, e.g., at least 98%, at least 99%, or 100% which encode a polypeptide having arabinofuranosidase activity.

The present invention also relates to isolated polynucleotides comprising or consisting of polynucleotides having a degree of sequence identity to the mature polypeptide coding sequence of SEQ ID NO: 160 of at least of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% which encode a polypeptide having arabinofuranosidase activity.

The present invention also relates to isolated polynucleotides comprising or consisting of polynucleotides having a degree of sequence identity to the mature polypeptide coding sequence of SEQ ID NO: 163 of at least of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% which encode a polypeptide having arabinofuranosidase activity.

The present invention also relates to isolated polynucleotides comprising or consisting of polynucleotides having a degree of sequence identity to the mature polypeptide coding sequence of SEQ ID NO: 166 of at least of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% which encode a polypeptide having arabinofuranosidase activity.

The present invention also relates to isolated polynucleotides comprising or consisting of polynucleotides having a degree of sequence identity to the mature polypeptide coding sequence of SEQ ID NO: 169 of at least of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% which encode a polypeptide having arabinofuranosidase activity.

The present invention also relates to isolated polynucleotides comprising or consisting of polynucleotides having a degree of sequence identity to the mature polypeptide coding sequence of SEQ ID NO: 172 of at least of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% which encode a polypeptide having arabinofuranosidase activity.

Modification of a polynucleotide encoding a polypeptide of the present invention may be necessary for synthesizing polypeptides substantially similar to the polypeptide. The term "substantially similar" to the polypeptide refers to non-naturally occurring forms of the polypeptide.

Nucleic Acid Constructs

The present invention also relates to nucleic acid constructs comprising a polynucleotide of the present invention operably linked to one or more control sequences that direct the expression of the coding sequence in a suitable host cell under conditions compatible with the control sequences.

The polynucleotide may be manipulated in a variety of ways to provide for expression of the polypeptide. Manipulation of the polynucleotide prior to its insertion into a vector may be desirable or necessary depending on the expression vector. The techniques for modifying polynucleotides utilizing recombinant DNA methods are well known in the art.

The control sequence may be a promoter, a polynucleotide that is recognized by a host cell for expression of a polynucleotide encoding a polypeptide of the present invention. The promoter contains transcriptional control sequences that mediate the expression of the polypeptide. The promoter may be any polynucleotide that shows transcriptional activity in the host cell including mutant, truncated, and hybrid promoters, and may be obtained from genes encoding extracellular or intracellular polypeptides either homologous or heterologous to the host cell.

Examples of suitable promoters for directing transcription of the nucleic acid constructs of the present invention in a bacterial host cell are the promoters obtained from the *Bacillus amyloliquefaciens* alpha-amylase gene (amyQ), *Bacillus licheniformis* alpha-amylase gene (amyL), *Bacillus licheniformis* penicillinase gene (penP), *Bacillus stearothermophilus* maltogenic amylase gene (amyM), *Bacillus subtilis* levansucrase gene (sacB), *Bacillus subtilis* xylA and xylB genes, *Bacillus thuringiensis* cryIIIA gene (Agaisse and Lereclus, 1994, *Molecular Microbiology* 13: 97-107), *E. coli* lac operon, *E. coli* trc promoter (Egon et al., 1988, *Gene* 69: 301-315), *Streptomyces coelicolor* agarase gene (dagA), and prokaryotic beta-lactamase gene (Villa-Kamaroff et al., 1978, *Proc. Natl. Acad. Sci. USA* 75: 3727-3731), as well as the tac promoter (DeBoer et al., 1983, *Proc. Natl. Acad. Sci. USA* 80: 21-25). Further promoters are described in "Useful proteins from recombinant bacteria" in Gilbert et al., 1980, *Scientific American* 242: 74-94; and in Sambrook et al., 1989, supra. Examples of tandem promoters are disclosed in WO 99/43835.

Examples of suitable promoters for directing transcription of the nucleic acid constructs of the present invention in a filamentous fungal host cell are promoters obtained from the genes for *Aspergillus nidulans* acetamidase, *Aspergillus niger* neutral alpha-amylase, *Aspergillus niger* acid stable alpha-amylase, *Aspergillus niger* or *Aspergillus awamori* glucoamylase (glaA), *Aspergillus oryzae* TAKA amylase, *Aspergillus oryzae* alkaline protease, *Aspergillus oryzae* triose phosphate isomerase, *Fusarium oxysporum* trypsin-like protease (WO 96/00787), *Fusarium venenatum* amyloglucosidase (WO 00/56900), *Fusarium venenatum* Daria (WO 00/56900), *Fusarium venenatum* Quinn (WO 00/56900), *Rhizomucor miehei* lipase, *Rhizomucor miehei* aspartic proteinase, *Trichoderma reesei* beta-glucosidase, *Trichoderma reesei* cellobiohydrolase I, *Trichoderma reesei* cellobiohydrolase II, *Trichoderma reesei* endoglucanase I, *Trichoderma reesei* endoglucanase II, *Trichoderma reesei* endoglucanase III, *Trichoderma reesei* endoglucanase V, *Trichoderma reesei* xylanase I, *Trichoderma reesei* xylanase II, *Trichoderma reesei* xylanase III, *Trichoderma reesei* beta-xylosidase, and *Trichoderma reesei* translation elongation factor, as well as the NA2-tpi promoter (a modified promoter from an *Aspergillus* neutral alpha-amylase gene in which the untranslated leader has been replaced by an untranslated leader from an *Aspergillus triose* phosphate isomerase gene; non-limiting examples include modified promoters from an *Aspergillus niger* neutral alpha-amylase gene in which the untranslated leader has been replaced by an untranslated leader from an *Aspergillus nidulans* or *Aspergillus oryzae* triose phosphate isomerase gene); and mutant, truncated, and hybrid promoters thereof. Other promoters are described in U.S. Pat. No. 6,011,147.

In a yeast host, useful promoters are obtained from the genes for *Saccharomyces cerevisiae* enolase (ENO-1), *Saccharomyces cerevisiae* galactokinase (GAL1), *Saccharomyces cerevisiae* alcohol dehydrogenase/glyceraldehyde-3-phosphate dehydrogenase (ADH1, ADH2/GAP), *Saccharomyces cerevisiae* triose phosphate isomerase (TPI), *Saccharomyces cerevisiae* metallothionein (CUP1), and *Saccharomyces cerevisiae* 3-phosphoglycerate kinase. Other useful promoters for yeast host cells are described by Romanos et al., 1992, *Yeast* 8: 423-488.

The control sequence may also be a transcription terminator, which is recognized by a host cell to terminate transcription. The terminator is operably linked to the 3'-terminus of the polynucleotide encoding the polypeptide. Any terminator that is functional in the host cell may be used in the present invention.

Preferred terminators for bacterial host cells are obtained from the genes for *Bacillus clausii* alkaline protease (aprH), Bacillus licheniformis alpha-amylase (amyL), and Escherichia coli ribosomal RNA (rrnB).

Preferred terminators for filamentous fungal host cells are obtained from the genes for Aspergillus nidulans acetamidase, Aspergillus nidulans anthranilate synthase, Aspergillus niger glucoamylase, Aspergillus niger alpha-glucosidase, Aspergillus oryzae TAKA amylase, Fusarium oxysporum trypsin-like protease, Trichoderma reesei beta-glucosidase, Trichoderma reesei cellobiohydrolase I, Trichoderma reesei cellobiohydrolase II, Trichoderma reesei endoglucanase I, Trichoderma reesei endoglucanase II, Trichoderma reesei endoglucanase III, Trichoderma reesei endoglucanase V, Trichoderma reesei xylanase I, Trichoderma reesei xylanase II, Trichoderma reesei xylanase III, Trichoderma reesei beta-xylosidase, and Trichoderma reesei translation elongation factor.

Preferred terminators for yeast host cells are obtained from the genes for Saccharomyces cerevisiae enolase, Saccharomyces cerevisiae cytochrome C (CYC1), and Saccharomyces cerevisiae glyceraldehyde-3-phosphate dehydrogenase. Other useful terminators for yeast host cells are described by Romanos et al., 1992, supra.

The control sequence may also be an mRNA stabilizer region downstream of a promoter and upstream of the coding sequence of a gene which increases expression of the gene.

Examples of suitable mRNA stabilizer regions are obtained from a Bacillus thuringiensis crylIIA gene (WO 94/25612) and a Bacillus subtilis SP82 gene (Hue et al., 1995, Journal of Bacteriology 177: 3465-3471).

The control sequence may also be a leader, a nontranslated region of an mRNA that is important for translation by the host cell. The leader is operably linked to the 5'-terminus of the polynucleotide encoding the polypeptide. Any leader that is functional in the host cell may be used.

Preferred leaders for filamentous fungal host cells are obtained from the genes for Aspergillus oryzae TAKA amylase and Aspergillus nidulans triose phosphate isomerase.

Suitable leaders for yeast host cells are obtained from the genes for Saccharomyces cerevisiae enolase (ENO-1), Saccharomyces cerevisiae 3-phosphoglycerate kinase, Saccharomyces cerevisiae alpha-factor, and Saccharomyces cerevisiae alcohol dehydrogenase/glyceraldehyde-3-phosphate dehydrogenase (ADH2/GAP).

The control sequence may also be a polyadenylation sequence, a sequence operably linked to the 3'-terminus of the polynucleotide and, when transcribed, is recognized by the host cell as a signal to add polyadenosine residues to transcribed mRNA. Any polyadenylation sequence that is functional in the host cell may be used.

Preferred polyadenylation sequences for filamentous fungal host cells are obtained from the genes for Aspergillus nidulans anthranilate synthase, Aspergillus niger glucoamylase, Aspergillus niger alpha-glucosidase Aspergillus oryzae TAKA amylase, and Fusarium oxysporum trypsin-like protease.

Useful polyadenylation sequences for yeast host cells are described by Guo and Sherman, 1995, Mol. Cellular Biol. 15: 5983-5990.

The control sequence may also be a signal peptide coding region that encodes a signal peptide linked to the N-terminus of a polypeptide and directs the polypeptide into the cell's secretory pathway. The 5'-end of the coding sequence of the polynucleotide may inherently contain a signal peptide coding sequence naturally linked in translation reading frame with the segment of the coding sequence that encodes the polypeptide. Alternatively, the 5'-end of the coding sequence may contain a signal peptide coding sequence that is foreign to the coding sequence. A foreign signal peptide coding sequence may be required where the coding sequence does not naturally contain a signal peptide coding sequence. Alternatively, a foreign signal peptide coding sequence may simply replace the natural signal peptide coding sequence in order to enhance secretion of the polypeptide. However, any signal peptide coding sequence that directs the expressed polypeptide into the secretory pathway of a host cell may be used.

Effective signal peptide coding sequences for bacterial host cells are the signal peptide coding sequences obtained from the genes for Bacillus NCIB 11837 maltogenic amylase, Bacillus licheniformis subtilisin, Bacillus licheniformis beta-lactamase, Bacillus stearothermophilus alpha-amylase, Bacillus stearothermophilus neutral proteases (nprT, nprS, nprM), and Bacillus subtilis prsA. Further signal peptides are described by Simonen and Palva, 1993, Microbiological Reviews 57: 109-137.

Effective signal peptide coding sequences for filamentous fungal host cells are the signal peptide coding sequences obtained from the genes for Aspergillus niger neutral amylase, Aspergillus niger glucoamylase, Aspergillus oryzae TAKA amylase, Humicola insolens cellulase, Humicola insolens endoglucanase V, Humicola lanuginosa lipase, and Rhizomucor miehei aspartic proteinase.

Useful signal peptides for yeast host cells are obtained from the genes for Saccharomyces cerevisiae alpha-factor and Saccharomyces cerevisiae invertase. Other useful signal peptide coding sequences are described by Romanos et al., 1992, supra.

The control sequence may also be a propeptide coding sequence that encodes a propeptide positioned at the N-terminus of a polypeptide. The resultant polypeptide is known as a proenzyme or propolypeptide (or a zymogen in some cases). A propolypeptide is generally inactive and can be converted to an active polypeptide by catalytic or autocatalytic cleavage of the propeptide from the propolypeptide. The propeptide coding sequence may be obtained from the genes for Bacillus subtilis alkaline protease (aprE), Bacillus subtilis neutral protease (nprT), Myceliophthora thermophila laccase (WO 95/33836), Rhizomucor miehei aspartic proteinase, and Saccharomyces cerevisiae alpha-factor.

Where both signal peptide and propeptide sequences are present, the propeptide sequence is positioned next to the N-terminus of a polypeptide and the signal peptide sequence is positioned next to the N-terminus of the propeptide sequence.

It may also be desirable to add regulatory sequences that regulate expression of the polypeptide relative to the growth of the host cell. Examples of regulatory sequences are those that cause expression of the gene to be turned on or off in response to a chemical or physical stimulus, including the presence of a regulatory compound. Regulatory sequences in prokaryotic systems include the lac, tac, and trp operator systems. In yeast, the ADH2 system or GAL1 system may be used. In filamentous fungi, the Aspergillus niger glucoamylase promoter, Aspergillus oryzae TAKA alpha-amylase promoter, and Aspergillus oryzae glucoamylase promoter, Trichoderma reesei cellobiohydrolase I promoter, and Trichoderma reesei cellobiohydrolase II promoter may be used. Other examples of regulatory sequences are those that allow for gene amplification. In eukaryotic systems, these regulatory sequences include the dihydrofolate reductase gene that is amplified in the presence of methotrexate, and the metallothionein genes that are amplified with heavy metals. In these cases, the polynucleotide encoding the polypeptide would be operably linked to the regulatory sequence.

Expression Vectors

The present invention also relates to recombinant expression vectors comprising a polynucleotide of the present invention, a promoter, and transcriptional and translational stop signals. The various nucleotide and control sequences may be joined together to produce a recombinant expression vector that may include one or more convenient restriction sites to allow for insertion or substitution of the polynucleotide encoding the polypeptide at such sites. Alternatively, the polynucleotide may be expressed by inserting the polynucleotide or a nucleic acid construct comprising the polynucleotide into an appropriate vector for expression. In creating the expression vector, the coding sequence is located in the vector so that the coding sequence is operably linked with the appropriate control sequences for expression.

The recombinant expression vector may be any vector (e.g., a plasmid or virus) that can be conveniently subjected to recombinant DNA procedures and can bring about expression of the polynucleotide. The choice of the vector will typically depend on the compatibility of the vector with the host cell into which the vector is to be introduced. The vector may be a linear or closed circular plasmid.

The vector may be an autonomously replicating vector, i.e., a vector that exists as an extrachromosomal entity, the replication of which is independent of chromosomal replication, e.g., a plasmid, an extrachromosomal element, a minichromosome, or an artificial chromosome. The vector may contain any means for assuring self-replication. Alternatively, the vector may be one that, when introduced into the host cell, is integrated into the genome and replicated together with the chromosome(s) into which it has been integrated. Furthermore, a single vector or plasmid or two or more vectors or plasmids that together contain the total DNA to be introduced into the genome of the host cell, or a transposon, may be used.

The vector preferably contains one or more selectable markers that permit easy selection of transformed, transfected, transduced, or the like cells. A selectable marker is a gene the product of which provides for biocide or viral resistance, resistance to heavy metals, prototrophy to auxotrophs, and the like.

Examples of bacterial selectable markers are *Bacillus licheniformis* or *Bacillus subtilis* dal genes, or markers that confer antibiotic resistance such as ampicillin, chloramphenicol, kanamycin, neomycin, spectinomycin, or tetracycline resistance. Suitable markers for yeast host cells include, but are not limited to, ADE2, HIS3, LEU2, LYS2, MET5, TRP1, and URA3. Selectable markers for use in a filamentous fungal host cell include, but are not limited to, adeA (phosphoribosylaminoimidazole-succinocarboxamide synthase), adeB (phosphoribosyl-aminoimidazole synthase), amdS (acetamidase), argB (ornithine carbamoyltransferase), bar (phosphinothricin acetyltransferase), hph (hygromycin phosphotransferase), niaD (nitrate reductase), pyrG (orotidine-5'-phosphate decarboxylase), sC (sulfate adenyltransferase), and trpC (anthranilate synthase), as well as equivalents thereof. Preferred for use in an *Aspergillus* cell are *Aspergillus nidulans* or *Aspergillus oryzae* amdS and pyrG genes and a *Streptomyces hygroscopicus* bar gene. Preferred for use in a Trichoderma cell are adeA, adeB, amdS, hph, and pyrG genes.

The selectable marker may be a dual selectable marker system as described in WO 2010/039889. In one aspect, the dual selectable marker is an hph-tk dual selectable marker system.

The vector preferably contains an element(s) that permits integration of the vector into the host cell's genome or autonomous replication of the vector in the cell independent of the genome.

For integration into the host cell genome, the vector may rely on the polynucleotide's sequence encoding the polypeptide or any other element of the vector for integration into the genome by homologous or non-homologous recombination. Alternatively, the vector may contain additional polynucleotides for directing integration by homologous recombination into the genome of the host cell at a precise location(s) in the chromosome(s). To increase the likelihood of integration at a precise location, the integrational elements should contain a sufficient number of nucleic acids, such as 100 to 10,000 base pairs, 400 to 10,000 base pairs, and 800 to 10,000 base pairs, which have a high degree of sequence identity to the corresponding target sequence to enhance the probability of homologous recombination. The integrational elements may be any sequence that is homologous with the target sequence in the genome of the host cell. Furthermore, the integrational elements may be non-encoding or encoding polynucleotides. On the other hand, the vector may be integrated into the genome of the host cell by non-homologous recombination.

For autonomous replication, the vector may further comprise an origin of replication enabling the vector to replicate autonomously in the host cell in question. The origin of replication may be any plasmid replicator mediating autonomous replication that functions in a cell. The term "origin of replication" or "plasmid replicator" means a polynucleotide that enables a plasmid or vector to replicate in vivo.

Examples of bacterial origins of replication are the origins of replication of plasmids pBR322, pUC19, pACYC177, and pACYC184 permitting replication in *E. coli*, and pUB110, pE194, pTA1060, and pAMβ1 permitting replication in *Bacillus*.

Examples of origins of replication for use in a yeast host cell are the 2 micron origin of replication, ARS1, ARS4, the combination of ARS1 and CEN3, and the combination of ARS4 and CEN6.

Examples of origins of replication useful in a filamentous fungal cell are AMA1 and ANS1 (Gems et al., 1991, *Gene* 98: 61-67; Cullen et al., 1987, *Nucleic Acids Res.* 15: 9163-9175; WO 00/24883). Isolation of the AMA1 gene and construction of plasmids or vectors comprising the gene can be accomplished according to the methods disclosed in WO 00/24883.

More than one copy of a polynucleotide of the present invention may be inserted into a host cell to increase production of a polypeptide. An increase in the copy number of the polynucleotide can be obtained by integrating at least one additional copy of the sequence into the host cell genome or by including an amplifiable selectable marker gene with the polynucleotide where cells containing amplified copies of the selectable marker gene, and thereby additional copies of the polynucleotide, can be selected for by cultivating the cells in the presence of the appropriate selectable agent.

The procedures used to ligate the elements described above to construct the recombinant expression vectors of the present invention are well known to one skilled in the art (see, e.g., Sambrook et al., 1989, supra).

Host Cells

The present invention also relates to recombinant host cells, comprising a polynucleotide of the present invention operably linked to one or more control sequences that direct the production of a polypeptide of the present invention. A construct or vector comprising a polynucleotide is introduced into a host cell so that the construct or vector is maintained as a chromosomal integrant or as a self-replicating extra-chromosomal vector as described earlier. The term "host cell" encompasses any progeny of a parent cell that is not identical to the parent cell due to mutations that occur during replication. The choice of a host cell will to a large extent depend upon the gene encoding the polypeptide and its source.

The host cell may be any cell useful in the recombinant production of a polypeptide of the present invention, e.g., a prokaryote or a eukaryote.

The prokaryotic host cell may be any Gram-positive or Gram-negative *bacterium*. Gram-positive bacteria include, but are not limited to, *Bacillus, Clostridium, Enterococcus, Geobacillus, Lactobacillus, Lactococcus, Oceanobacillus, Staphylococcus, Streptococcus*, and *Streptomyces*. Gram-negative bacteria include, but are not limited to, *Campylobacter, E. coli, Flavobacterium, Fusobacterium, Helicobacter, Ilyobacter, Neisseria, Pseudomonas, Salmonella*, and *Ureaplasma*.

The bacterial host cell may be any *Bacillus* cell including, but not limited to, *Bacillus alkalophilus, Bacillus amyloliquefaciens, Bacillus brevis, Bacillus circulans, Bacillus clausii, Bacillus coagulans, Bacillus firmus, Bacillus lautus, Bacillus lentus, Bacillus licheniformis, Bacillus megaterium, Bacillus pumilus, Bacillus stearothermophilus, Bacillus subtilis*, and *Bacillus thuringiensis* cells.

The bacterial host cell may also be any *Streptococcus* cell including, but not limited to, *Streptococcus equisimilis, Streptococcus pyogenes, Streptococcus uberis*, and *Streptococcus equi* subsp. *Zooepidemicus* cells.

The bacterial host cell may also be any *Streptomyces* cell including, but not limited to, *Streptomyces achromogenes, Streptomyces avermitilis, Streptomyces coelicolor, Streptomyces griseus*, and *Streptomyces lividans* cells.

The introduction of DNA into a *Bacillus* cell may be effected by protoplast transformation (see, e.g., Chang and Cohen, 1979, *Mol. Gen. Genet.* 168: 111-115), competent cell transformation (see, e.g., Young and Spizizen, 1961, *J. Bacteriol.* 81: 823-829, or Dubnau and Davidoff-Abelson, 1971, *J. Mol. Biol.* 56: 209-221), electroporation (see, e.g., Shigekawa and Dower, 1988, *Biotechniques* 6: 742-751), or conjugation (see, e.g., Koehler and Thorne, 1987, *J. Bacteriol.* 169: 5271-5278). The introduction of DNA into an *E. coli* cell may be effected by protoplast transformation (see, e.g., Hanahan, 1983, *J. Mol. Biol.* 166: 557-580) or electroporation (see, e.g., Dower et al., 1988, *Nucleic Acids Res.* 16: 6127-6145). The introduction of DNA into a *Streptomyces* cell may be effected by protoplast transformation, electroporation (see, e.g., Gong et al., 2004, *Folia Microbiol. (Praha)* 49: 399-405), conjugation (see, e.g., Mazodier et al., 1989, *J. Bacteriol.* 171: 3583-3585), or transduction (see, e.g., Burke et al., 2001, *Proc. Natl. Acad. Sci. USA* 98: 6289-6294). The introduction of DNA into a *Pseudomonas* cell may be effected by electroporation (see, e.g., Choi et al., 2006, *J. Microbiol. Methods* 64: 391-397) or conjugation (see, e.g., Pinedo and Smets, 2005, *Appl. Environ. Microbiol.* 71: 51-57). The introduction of DNA into a *Streptococcus* cell may be effected by natural competence (see, e.g., Perry and Kuramitsu, 1981, *Infect. Immun.* 32: 1295-1297), protoplast transformation (see, e.g., Catt and Jollick, 1991, *Microbios* 68: 189-207), electroporation (see, e.g., Buckley et al., 1999, *Appl. Environ. Microbiol.* 65: 3800-3804), or conjugation (see, e.g., Clewell, 1981, *Microbiol. Rev.* 45: 409-436). However, any method known in the art for introducing DNA into a host cell can be used.

The host cell may also be a eukaryote, such as a mammalian, insect, plant, or fungal cell.

The host cell may be a fungal cell. "Fungi" as used herein includes the phyla Ascomycota, Basidiomycota, Chytridiomycota, and Zygomycota as well as the Oomycota and all mitosporic fungi (as defined by Hawksworth et al., In, *Ainsworth and Bisby's Dictionary of The Fungi*, 8th edition, 1995, CAB International, University Press, Cambridge, UK).

The fungal host cell may be a yeast cell. "Yeast" as used herein includes ascosporogenous yeast (Endomycetales), basidiosporogenous yeast, and yeast belonging to the Fungi Imperfecti (Blastomycetes). Since the classification of yeast may change in the future, for the purposes of this invention, yeast shall be defined as described in *Biology and Activities of Yeast* (Skinner, Passmore, and Davenport, editors, *Soc. App. Bacteriol. Symposium Series* No. 9, 1980).

The yeast host cell may be a *Candida, Hansenula, Kluyveromyces, Pichia, Saccharomyces, Schizosaccharomyces*, or *Yarrowia* cell, such as a *Kluyveromyces lactis, Saccharomyces carlsbergensis, Saccharomyces cerevisiae, Saccharomyces diastaticus, Saccharomyces douglasii, Saccharomyces kluyveri, Saccharomyces norbensis, Saccharomyces oviformis*, or *Yarrowia lipolytica* cell.

The fungal host cell may be a filamentous fungal cell. "Filamentous fungi" include all filamentous forms of the subdivision Eumycota and Oomycota (as defined by Hawksworth et al., 1995, supra). The filamentous fungi are generally characterized by a mycelial wall composed of chitin, cellulose, glucan, chitosan, mannan, and other complex polysaccharides. Vegetative growth is by hyphal elongation and carbon catabolism is obligately aerobic. In contrast, vegetative growth by yeasts such as *Saccharomyces cerevisiae* is by budding of a unicellular thallus and carbon catabolism may be fermentative.

The filamentous fungal host cell may be an *Acremonium, Aspergillus, Aureobasidium, Bjerkandera, Ceriporiopsis, Chrysosporium, Coprinus, Coriolus, Cryptococcus, Filibasidium, Fusarium, Humicola, Magnaporthe, Mucor, Myceliophthora, Neocallimastix, Neurospora, Paecilomyces, Penicillium, Phanerochaete, Phlebia, Piromyces, Pleurotus, Schizophyllum, Talaromyces, Thermoascus, Thielavia, Tolypocladium, Trametes*, or *Trichoderma* cell.

For example, the filamentous fungal host cell may be an *Aspergillus awamori, Aspergillus foetidus, Aspergillus fumigatus, Aspergillus japonicus, Aspergillus nidulans, Aspergillus niger, Aspergillus oryzae, Bjerkandera adusta, Ceriporiopsis aneirina, Ceriporiopsis caregiea, Ceriporiopsis gilvescens, Ceriporiopsis pannocinta, Ceriporiopsis rivulosa, Ceriporiopsis subrufa, Ceriporiopsis subvermispora, Chrysosporium inops, Chrysosporium keratinophilum, Chrysosporium lucknowense, Chrysosporium merdarium, Chrysosporium pannicola, Chrysosporium queenslandicum, Chrysosporium tropicum, Chrysosporium zonatum, Coprinus cinereus, Coriolus hirsutus, Fusarium bactridioides, Fusarium cerealis, Fusarium crookwellense, Fusarium culmorum, Fusarium graminearum, Fusarium graminum, Fusarium heterosporum, Fusarium negundi, Fusarium oxysporum, Fusarium reticulatum, Fusarium roseum, Fusarium sambucinum, Fusarium sarcochroum, Fusarium sporotrichioides, Fusarium sulphureum, Fusarium torulosum, Fusarium trichothecioides, Fusarium* venenatum, Humicola insolens, Humicola lanuginosa, Mucor miehei, Myceliophthora thermophila, Neurospora crassa, Penicillium purpurogenum, Phanerochaete chrysosporium, Phlebia radiata, Pleurotus eryngii, Thielavia terrestris, Trametes villosa, Trametes versicolor, Trichoderma harzianum, Trichoderma koningii, Trichoderma longibrachiatum, Trichoderma reesei, or Trichoderma viride cell.

Fungal cells may be transformed by a process involving protoplast formation, transformation of the protoplasts, and regeneration of the cell wall in a manner known per se. Suitable procedures for transformation of *Aspergillus* and *Trichoderma* host cells are described in EP 238023, Yelton et al., 1984, *Proc. Natl. Acad. Sci. USA* 81: 1470-1474, and Christensen et al., 1988, *Bio/Technology* 6: 1419-1422. Suitable methods for transforming *Fusarium* species are described by Malardier et al., 1989, *Gene* 78: 147-156, and WO 96/00787. Yeast may be transformed using the procedures described by Becker and Guarente, In Abelson, J. N. and Simon, M. I., editors, *Guide to Yeast Genetics and Molecular Biology, Methods in Enzymology*, Volume 194, pp 182-187, Academic Press, Inc., New York; Ito et al., 1983, *J. Bacteriol.* 153: 163; and Hinnen et al., 1978, *Proc. Natl. Acad. Sci. USA* 75: 1920.

Methods of Production

The present invention also relates to methods of producing a polypeptide of the present invention, comprising (a) cultivating a cell, which in its wild-type form produces the polypeptide, under conditions conducive for production of the polypeptide; and optionally, (b) recovering the polypeptide. The polypeptide may for example be any of the second to the twenty-eighth aspect of the invention.

In one aspect, the cell is a *Penicillium* cell. In another aspect, the cell is a *Penicillium aurantiogriseum* cell. In a further aspect, the cell is a *Penicillium oxalicum* cell. In a further aspect, the cell is a *Penicillium capsulatum* cell. In a further aspect, the cell is a *Penicillium soppii* cell. In one aspect, the cell is an *Aspergillus* cell. In another aspect, the cell is an *Aspergillus clavatus* cell. In a further aspect, the cell is an *Aspergillus wentii* cell. In a further aspect, the cell is an *Aspergillus aculeatus* cell. In a further aspect, the cell is an *Aspergillus fumigatiaffinis* cell.

In one aspect, the cell is a *Neosartorya* cell. In another aspect, the cell is a *Neosartorya fischeri* cell. In one aspect, the cell is a *Talaromyces* cell. In another aspect, the cell is a *Talaromyces pinophilus* cell. In one aspect, the cell is a *Ustilago* cell. In another aspect, the cell is a *Ustilago maydis* cell. In one aspect, the cell is an *Acrophialophora* cell. In another aspect, the cell is an *Acrophialophora fusispora* cell. In one aspect, the cell is a *Streptomyces* cell. In another aspect, the cell is a *Streptomyces nitrosporeus* cell. In a further aspect, the cell is a *Streptomyces beijiangensis* cell. In one aspect, the cell is a *Streptosporangium* cell. In another aspect, the cell is a *Streptosporangium* sp-60756 cell.

In one aspect, the cell is a *Lasiodiplodia* cell. In another aspect, the cell is a *Lasiodiplodia theobromae* cell. In one aspect, the cell is an *Ascobolus* cell. In another aspect, the cell is a *Ascobolus stictoideus* cell. In one aspect, the cell is a *Drechslera* cell. In another aspect, the cell is a *Drechslera* sp cell. In one aspect, the cell is a *Xylanibacterium* cell. In another aspect, the cell is a *Xylanibacterium* sp-61981 cell. In one aspect, the cell is a *Microdochium* cell. In another aspect, the cell is a *Microdochium nivale* cell. In one aspect, the cell is a *Humicola* cell. In another aspect, the cell is a *Humicola hyalothermophila* cell. In another aspect, the cell is a *Humicola* sp cell.

In one aspect, the cell is a *Curvularia* cell. In another aspect, the cell is a *Curvularia geniculata* cell. In one aspect, the cell is a *Glycomyces* cell. In another aspect, the cell is a *Glycomyces rutgersensis* cell. In one aspect, the cell is a *Remersonia* cell. In another aspect, the cell is a *Remersonia thermophile* cell. In one aspect, the cell is a *Thielavia* cell. In another aspect, the cell is a *Thielavia arenaria* cell. In another aspect, the cell is a *Thielavia terricola* cell. In one aspect, the cell is a *Chaetomium* cell. In another aspect, the cell is a *Chaetomium olivicolor* cell.

The present invention also relates to methods of producing a polypeptide of the present invention, comprising (a) cultivating a recombinant host cell of the present invention under conditions conducive for production of the polypeptide; and optionally, (b) recovering the polypeptide. The polypeptide may for example be any of the second to the twenty-eighth aspect of the invention.

The host cells are cultivated in a nutrient medium suitable for production of the polypeptide using methods known in the art. For example, the cells may be cultivated by shake flask cultivation, or small-scale or large-scale fermentation (including continuous, batch, fed-batch, or solid state fermentations) in laboratory or industrial fermentors in a suitable medium and under conditions allowing the polypeptide to be expressed and/or isolated. The cultivation takes place in a suitable nutrient medium comprising carbon and nitrogen sources and inorganic salts, using procedures known in the art. Suitable media are available from commercial suppliers or may be prepared according to published compositions (e.g., in catalogues of the American Type Culture Collection). If the polypeptide is secreted into the nutrient medium, the polypeptide can be recovered directly from the medium. If the polypeptide is not secreted, it can be recovered from cell lysates.

The polypeptide may be detected using methods known in the art that are specific for the polypeptides. These detection methods include, but are not limited to, use of specific antibodies, formation of an enzyme product, or disappearance of an enzyme substrate. For example, an enzyme assay may be used to determine the activity of the polypeptide.

The polypeptide may be recovered using methods known in the art. For example, the polypeptide may be recovered from the nutrient medium by conventional procedures including, but not limited to, collection, centrifugation, filtration, extraction, spray-drying, evaporation, or precipitation. In one aspect, a fermentation broth comprising the polypeptide is recovered.

The polypeptide may be purified by a variety of procedures known in the art including, but not limited to, chromatography (e.g., ion exchange, affinity, hydrophobic, chromatofocusing, and size exclusion), electrophoretic procedures (e.g., preparative isoelectric focusing), differential solubility (e.g., ammonium sulfate precipitation), SDS-PAGE, or extraction (see, e.g., *Protein Purification*, Janson and Ryden, editors, VCH Publishers, New York, 1989) to obtain substantially pure polypeptides.

In an alternative aspect, the polypeptide is not recovered, but rather a host cell of the present invention expressing the polypeptide is used as a source of the polypeptide.

Fermentation Broth Formulations or Cell Compositions

The present invention also relates to a fermentation broth formulation or a cell composition comprising a polypeptide of the present invention. The fermentation broth product further comprises additional ingredients used in the fermentation process, such as, for example, cells (including, the host cells containing the gene encoding the polypeptide of the present invention which are used to produce the polypeptide of interest), cell debris, biomass, fermentation media and/or fermentation products. In some embodiments, the composition is a cell-killed whole broth containing organic acid(s), killed cells and/or cell debris, and culture medium.

The term "fermentation broth" as used herein refers to a preparation produced by cellular fermentation that undergoes no or minimal recovery and/or purification. For example, fermentation broths are produced when microbial cultures are grown to saturation, incubated under carbon-limiting conditions to allow protein synthesis (e.g., expression of enzymes by host cells) and secretion into cell culture medium. The fermentation broth can contain unfractionated or fractionated contents of the fermentation materials derived at the end of the fermentation. Typically, the fermentation broth is unfractionated and comprises the spent culture medium and cell debris present after the microbial cells (e.g., filamentous fungal cells) are removed, e.g., by centrifugation. In some embodiments, the fermentation broth contains spent cell culture medium, extracellular enzymes, and viable and/or nonviable microbial cells.

In an embodiment, the fermentation broth formulation and cell compositions comprise a first organic acid component comprising at least one 1-5 carbon organic acid and/or a salt thereof and a second organic acid component comprising at least one 6 or more carbon organic acid and/or a salt thereof. In a specific embodiment, the first organic acid component is acetic acid, formic acid, propionic acid, a salt thereof, or a mixture of two or more of the foregoing and the second organic acid component is benzoic acid, cyclohexanecarboxylic acid, 4-methylvaleric acid, phenylacetic acid, a salt thereof, or a mixture of two or more of the foregoing.

In one aspect, the composition contains an organic acid(s), and optionally further contains killed cells and/or cell debris. In one embodiment, the killed cells and/or cell debris are removed from a cell-killed whole broth to provide a composition that is free of these components.

The fermentation broth formulations or cell compositions may further comprise a preservative and/or anti-microbial (e.g., bacteriostatic) agent, including, but not limited to, sorbitol, sodium chloride, potassium sorbate, and others known in the art.

The cell-killed whole broth or composition may contain the unfractionated contents of the fermentation materials derived at the end of the fermentation. Typically, the cell-killed whole broth or composition contains the spent culture medium and cell debris present after the microbial cells (e.g., filamentous fungal cells) are grown to saturation, incubated under carbon-limiting conditions to allow protein synthesis. In some embodiments, the cell-killed whole broth or composition contains the spent cell culture medium, extracellular enzymes, and killed filamentous fungal cells. In some embodiments, the microbial cells present in the cell-killed whole broth or composition can be permeabilized and/or lysed using methods known in the art.

A whole broth or cell composition as described herein is typically a liquid, but may contain insoluble components, such as killed cells, cell debris, culture media components, and/or insoluble enzyme(s). In some embodiments, insoluble components may be removed to provide a clarified liquid composition.

The whole broth formulations and cell compositions of the present invention may be produced by a method described in WO 90/15861 or WO 2010/096673.

Enzyme Compositions

Preferably, the compositions are enriched in the polypeptides of the first aspect of the invention. The term "enriched" indicates that the arabinofuranosidase activity and the xylanase activity of the composition has been increased, e.g., with an enrichment factor of at least 1.1, such as at least 1.2, at least 1.3, at least 1.4, at least 1.5, at least 2.0, at least 3.0, at least 4.0, at least 5.0, at least 10. In an embodiment, the composition comprises the polypeptides of the first aspect of the invention and one or more formulating agents, as described in the 'formulating agent' section below.

The present invention also relates to compositions comprising the polypeptide of any of the second to the twenty-fifth aspect of the invention having arabinofuranosidase activity. Preferably, the compositions are enriched in the polypeptide of the second aspect of the invention. The term "enriched" indicates that the arabinofuranosidase activity of the composition has been increased, e.g., with an enrichment factor of at least 1.1, such as at least 1.2, at least 1.3, at least 1.4, at least 1.5, at least 2.0, at least 3.0, at least 4.0, at least 5.0, at least 10. In an embodiment, the composition comprises the polypeptide of the second aspect of the invention and one or more formulating agents, as described in the 'formulating agent' section below. In a further embodiment, the composition further comprises one or more GH10 or GH11 polypeptides having xylanase activity.

The present invention also relates to compositions comprising the polypeptide of any of the twenty-sixth to the twenty-eighth aspect of the invention having xylanase activity. Preferably, the compositions are enriched in the polypeptide of the second aspect of the invention. The term "enriched" indicates that the arabinofuranosidase activity of the composition has been increased, e.g., with an enrichment factor of at least 1.1, such as at least 1.2, at least 1.3, at least 1.4, at least 1.5, at least 2.0, at least 3.0, at least 4.0, at least 5.0, at least 10. In an embodiment, the composition comprises the polypeptide of the second aspect of the invention and one or more formulating agents, as described in the 'formulating agent' section below. In a further embodiment, the composition further comprises one or more GH62 polypeptides having arabinofuranosidase activity.

The compositions may comprise a polypeptide of the present invention as the major enzymatic component, e.g., a mono-component composition. Such a composition may further comprise a formulating agent, as described in the 'formulating agent' section below. Alternatively, the compositions may comprise multiple enzymatic activities, such as one or more (e.g., several) enzymes selected from the group consisting of phytase, xylanase, galactanase, alpha-galactosidase, protease, phospholipase, glucoronidase, lysophospholipase, amylase, beta-glucanase, arabinofuranosidase, beta-xylosidase, endo-1,4-beta-xylanase acetyl xylan esterase, feruloyl esterase, cellulase, cellobiohydrolase, beta-glycosidase, pullulanase, or any mixture thereof.

It is at present contemplated that the xylanase is used in one or more of the following amounts (dosage ranges): 0.01-200; 0.05-100; 0.1-50; 0.2-20; 0.1-1; 0.2-2; 0.5-5; or 1-10 wherein all these ranges are mg xylanase protein per kg substrate (ppm). It is at present contemplated that the arabinofuranosidase is administered in one or more of the following amounts (dosage ranges): 0.01-200; 0.05-100; 0.1-50; 0.2-20; 0.1-1; 0.2-2; 0.5-5; or 1-10 wherein all these ranges are mg arabinofuranosidase protein per kg substrate (ppm). It is further contemplated that the ratio of the GH10 or 11 xylanase to GH62 arabinofuranosidase is in the range of 100:1 to 1:100 xylanase: arabinofuranosidase such as the ranges 50:1 to 1:50, 50:1 to 1:10, 25:1 to 1:5, 10:1 to 1:2 or such as 10:1 to 1:50, 5:1 to 1:25, 2:1 to 1:10 xylanase:arabinofuranosidase.

Formulating Agent

The enzyme of the invention may be formulated as a liquid or a solid. For a liquid formulation, the formulating agent may comprise a polyol (such as e.g. glycerol, ethylene glycol or propylene glycol), a salt (such as e.g. sodium chloride, sodium benzoate, potassium sorbate) or a sugar or sugar derivative (such as e.g. dextrin, glucose, sucrose, and sorbitol). Thus in one embodiment, the composition is a liquid composition comprising the polypeptide of the invention and one or more formulating agents selected from the list consisting of glycerol, ethylene glycol, 1,2-propylene glycol, 1,3-propylene glycol, sodium chloride, sodium benzoate, potassium sorbate, dextrin, glucose, sucrose, and sorbitol.

For a solid formulation, the formulation may be for example as a granule, spray dried powder or agglomerate. The formulating agent may comprise a salt (organic or inorganic zinc, sodium, potassium or calcium salts such as e.g. such as calcium acetate, calcium benzoate, calcium carbonate, calcium chloride, calcium citrate, calcium sorbate, calcium sulfate, potassium acetate, potassium benzoate, potassium carbonate, potassium chloride, potassium citrate, potassium sorbate, potassium sulfate, sodium acetate, sodium benzoate, sodium carbonate, sodium chloride, sodium citrate, sodium sulfate, zinc acetate, zinc benzoate, zinc carbonate, zinc chloride, zinc citrate, zinc sorbate, zinc sulfate), starch or a sugar or sugar derivative (such as e.g. sucrose, dextrin, glucose, lactose, sorbitol).

In an embodiment, the solid composition is in granulated form. The granule may have a matrix structure where the components are mixed homogeneously. However, the granule typically comprises a core particle and one or more coatings, which typically are salt and/or wax coatings. The core particle can either be a homogeneous blend of xylanase of the invention optionally combined with one or more additional enzymes and optionally together with one or more salts or an inert particle with the xylanase of the invention optionally combined with one or more additional enzymes applied onto it.

In an embodiment, the material of the core particles are selected from the group consisting of inorganic salts (such as calcium acetate, calcium benzoate, calcium carbonate, calcium chloride, calcium citrate, calcium sorbate, calcium sulfate, potassium acetate, potassium benzoate, potassium carbonate, potassium chloride, potassium citrate, potassium sorbate, potassium sulfate, sodium acetate, sodium benzoate, sodium carbonate, sodium chloride, sodium citrate, sodium sulfate, zinc acetate, zinc benzoate, zinc carbonate, zinc chloride, zinc citrate, zinc sorbate, zinc sulfate), starch or a sugar or sugar derivative (such as e.g. sucrose, dextrin, glucose, lactose, sorbitol), sugar or sugar derivative (such as e.g. sucrose, dextrin, glucose, lactose, sorbitol), small organic molecules, starch, flour, cellulose and minerals.

The salt coating is typically at least 1 µm thick and can either be one particular salt or a mixture of salts, such as $Na_2SO_4$, $K_2SO_4$, $MgSO_4$ and/or sodium citrate. Other examples are those described in e.g. WO 2008/017659, WO 2006/034710, WO 1997/05245, WO 1998/54980, WO 1998/55599, WO 2000/70034 or polymer coating such as described in WO 2001/00042.

In another embodiment, the composition is a solid composition comprising the xylanase of the invention and one or more formulating agents selected from the list consisting of sodium chloride, sodium benzoate, potassium sorbate, sodium sulfate, potassium sulfate, magnesium sulfate, sodium thiosulfate, calcium carbonate, sodium citrate, dextrin, glucose, sucrose, sorbitol, lactose, starch and cellulose.

In a preferred embodiment, the formulating agent is selected from one or more of the following compounds: sodium sulfate, dextrin, cellulose, sodium thiosulfate and calcium carbonate. In a preferred embodiment, the solid composition is in granulated form. In an embodiment, the solid composition is in granulated form and comprises a core particle, an enzyme layer comprising the xylanase of the invention and a salt coating.

In a further embodiment, the formulating agent is selected from one or more of the following compounds: glycerol, ethylene glycol, 1,2-propylene glycol or 1,3-propylene glycol, sodium chloride, sodium benzoate, potassium sorbate, sodium sulfate, potassium sulfate, magnesium sulfate, sodium thiosulfate, calcium carbonate, sodium citrate, dextrin, glucose, sucrose, sorbitol, lactose, starch and cellulose. In a preferred embodiment, the formulating agent is selected from one or more of the following compounds: 1,2-propylene glycol, 1,3-propylene glycol, sodium sulfate, dextrin, cellulose, sodium thiosulfate and calcium carbonate.

Plant Based Material from the Sub-Family Panicoideae

In one embodiment, the plant based material from the sub-family Panicoideae is from the tribe Andropogoneae such as the rank *Andropogon* or *Andropterum* or *Apluda* or *Apocopis* or *Arthraxon* or *Bothriochloa* or *Capillipedium* or *Chionachne* or *Chrysopogon* or *Coelorachis* or *Coix* or *Cymbopogon* or *Dichanthium* or *Diheteropogon* or *Dimeria* or *Elionurus* or *Eremochloa* or *Euclasta* or *Eulalia* or *Germainia* or *Hemarthria* or *Heteropholis* or *Heteropogon* or *Hyparrhenia* or *Hyperthelia* or *Imperata* or *Ischaemum* or *Iseilema* or *Kerriochloa* or *Microstegium* or *Miscanthidium* or *Miscanthus* or *Mnesithea* or *Ophiuros* or *Oxyrhachis* or *Phacelurus* or *Pholiurus* or *Pogonatherum* or *Polytoca* or *Polytrias* or *Pseudopogonatherum* or *Pseudosorghum* or *Rhytachne* or *Rottboellia* or *Saccharum* or *Sarga* or *Schizachyrium* or *Sehima* or *Sorghastrum* or *Sorghum* or *Spodiopogon* or *Thaumastochloa* or *Thelepogon* or *Themeda* or *Trachypogon* or *Triarrhena* or *Tripsacum* or *Urelytrum* or *Vetiveria* or *Vossia* or *Xerochloa* or *Zea*.

In a preferred embodiment, the plant based material from the sub-family Panicoideae is from the rank *Zea*, such as the species *Zea diploperennis, Zea luxurians, Zea mays, Zea nicaraguensis* or *Zea perennis*.

In a preferred embodiment, the plant based material from the sub-family Panicoideae is from the rank *Sorghum*, such as the species *Sorghum amplum, Sorghum angustum, Sorghum arundinaceum, Sorghum australiense, Sorghum bicolor, Sorghum brachypodum, Sorghum bulbosum, Sorghum ecarinatum, Sorghum exstans, Sorghum grande, Sorghum halepense, Sorghum hybrid cultivar, Sorghum interjectum, Sorghum intrans, Sorghum laxiflorum, Sorghum leiocladum, Sorghum macrospermum, Sorghum matarankense, Sorghum nitidum, Sorghum plumosum, Sorghum propinquum, Sorghum purpureosericeum, Sorghum stipoideum, Sorghum sudanense, Sorghum timorense, Sorghum versicolor, Sorghum* sp. 'Silk' or *Sorghum* sp. as defined in WO2007/002267.

In another embodiment, the plant based material from the sub-family Panicoideae is from the tribe *Paniceae* such as the rank *Acritochaete, Acroceras, Alexfloydia, Alloteropsis, Amphicarpum, Ancistrachne, Anthephora, Brachiaria, Calyptochloa, Cenchrus, Chaetium, Chaetopoa, Chamaeraphis, Chlorocalymma, Cleistochloa, Cyphochlaena, Cyrtococcum, Dichanthelium, Digitaria, Dissochondrus, Echinochloa, Entolasia, Eriochloa, Homopholis, Hygrochloa, Hylebates, Ixophorus, Lasiacis, Leucophrys, Louisiella, Megaloprotachne, Megathyrsus, Melinis, Microcalamus, Moorochloa, Neurachne, Odontelytrum, Oplismenus,*

*Ottochloa, Panicum, Paractaenum, Paraneurachne, Paratheria, Parodiophyllochloa, Paspalidium, Pennisetum, Plagiosetum, Poecilostachys, Pseudechinolaena, Pseudochaetochloa, Pseudoraphis, Rupichloa, Sacciolepis, Scutachne, Setaria, Setariopsis, Snowdenia, Spinifex, Stenotaphrum, Stereochlaena, Thrasya, Thuarea, Thyridolepis, Tricholaena,* unclassified *Paniceae, Uranthoecium, Urochloa, Walwhalleya, Whiteochloa, Yakirra, Yvesia, Zuloagaea* or *Zygochloa.*

In a preferred embodiment, the plant based material from the sub-family Panicoideae is from the rank *Panicum*, such as the species *Panicum adenophorum, Panicum* aff. *aquaticum* JKT-2012, *Panicum amarum, Panicum antidotale, Panicum aquaticum, Panicum arctum, Panicum arundinariae, Panicum atrosanguineum, Panicum auricomum, Panicum auritum, Panicum bartlettii, Panicum bergii, Panicum bisulcatum, Panicum boliviense, Panicum brazzavillense, Panicum brevifolium, Panicum caaguazuense, Panicum campestre, Panicum capillare, Panicum cayennense, Panicum cayoense, Panicum cervicatum, Panicum chloroleucum, Panicum claytonii, Panicum coloratum, Panicum cyanescens, Panicum decompositum, Panicum deustum, Panicum dichotomiflorum, Panicum dinklagei, Panicum distichophyllum, Panicum dregeanum, Panicum elephantipes, Panicum fauriei, Panicum flexile, Panicum fluviicola, Panicum gouinii, Panicum gracilicaule, Panicum granuliferum, Panicum guatemalense, Panicum hallii, Panicum heterostachyum, Panicum hirticaule, Panicum hirtum, Panicum hylaeicum, Panicum incumbens, Panicum infestum, Panicum italicum, Panicum laetum, Panicum laevinode, Panicum lanipes, Panicum larcomianum, Panicum longpedicellatum, Panicum machrisianum, Panicum malacotrichum, Panicum margaritiferum, Panicum micranthum, Panicum miliaceum, Panicum milioides, Panicum millegrana, Panicum mystasipum, Panicum natalense, Panicum nephelophilum, Panicum nervosum, Panicum notatum, Panicum olyroides, Panicum paludosum, Panicum pansum, Panicum pantrichum, Panicum parvifolium, Panicum parviglume, Panicum pedersenii, Panicum penicillatum, Panicum petersonii, Panicum phragmitoides, Panicum piauiense, Panicum pilosum, Panicum pleianthum, Panicum polycomum, Panicum polygonatum, Panicum pseudisachne, Panicum pygmaeum, Panicum pyrularium, Panicum queenslandicum, Panicum racemosum, Panicum repens, Panicum rhizogonum, Panicum rigidulum, Panicum rivale, Panicum rude, Panicum rudgei, Panicum schinzii, Panicum schwackeanum, Panicum sellowii, Panicum seminudum, Panicum stapfianum, Panicum stenodes, Panicum stramineum, Panicum subalbidum, Panicum subtiramulosum, Panicum sumatrense, Panicum tenellum, Panicum tenuifolium, Panicum trichanthum, Panicum trichidiachne, Panicum trichoides, Panicum tricholaenoides, Panicum tuerckheimii, Panicum turgidum, Panicum urvilleanum, Panicum validum, Panicum venezuelae, Panicum verrucosum, Panicum virgatum, Panicum wettsteinii, Panicum* sp., *Panicum* sp. Christin 16-200, *Panicum* sp. ELS-2011, *Panicum* sp. EM389 or *Panicum* sp. Forest 761.

In a further embodiment, the plant based material from the sub-family Panicoideae is maize (*Zea*), corn (*Zea*), sorghum (*Sorghum*), switchgrass (*Panicum virgatum*), millet (*Panicum miliaceum*), pearl millet (*Cenchrus violaceus* also called *Pennisetum glaucum*), foxtail millet (*Setaria italica* also called *Panicum italicum*) or in a processed form such as milled corn, milled maize, defatted maize, defatted destarched maize, milled sorghum, milled switchgrass, milled millet, milled foxtail millet, milled pearl millet, or any combination thereof.

In an embodiment, the plant based material from the sub-family Panicoideae is from the seed of the plant. In a preferred embodiment, the plant based material from the sub-family Panicoideae is from the seed of maize (*Zea*), corn (*Zea*), sorghum (*Sorghum*), switchgrass (*Panicum virgatum*), millet (*Panicum miliaceum*), pearl millet (*Cenchrus violaceus* also called *Pennisetum glaucum*), foxtail millet (*Setaria italica* also called *Panicum italicum*) or wherein the seed has been processed such as milled corn, milled maize, defatted maize, defatted destarched maize, milled sorghum, milled switchgrass, milled millet, milled foxtail millet, milled pearl millet, or any combination thereof.

Animal Feed and Animal Feed Additives

The present invention also relates to animal feeds and animal feed additives comprising the composition of the first aspect of the invention. In an embodiment, the animal feed additive comprises a formulating agent and the composition of the first aspect of the invention. In an embodiment, the animal feed comprises a formulating agent and the composition of the first aspect of the invention. In a further embodiment, the formulating agent comprises one or more of the following compounds: glycerol, ethylene glycol, 1,2-propylene glycol or 1,3-propylene glycol, sodium chloride, sodium benzoate, potassium sorbate, sodium sulfate, potassium sulfate, magnesium sulfate, sodium thiosulfate, calcium carbonate, sodium citrate, dextrin, glucose, sucrose, sorbitol, lactose, starch and cellulose.

In an embodiment, the animal feed or animal feed additive comprises one or more additional enzymes. In an embodiment, the animal feed or animal feed additive comprises one or more microbes. In an embodiment, the animal feed or animal feed additive comprises one or more vitamins. In an embodiment, the animal feed or animal feed additive comprises one or more minerals. In an embodiment, the animal feed or animal feed additive comprises one or more amino acids. In a further embodiment, the animal feed or animal feed additive further comprises one or more formulating agents and one or more components selected from the list consisting of: one or more additional enzymes; one or more microbes; one or more vitamins; one or more minerals; one or more amino acids; and one or more other feed ingredients.

The present invention also relates to animal feeds and animal feed additives comprising the polypeptide of any of the second to the twenty-eighth aspect of the invention. In an embodiment, the animal feed or animal feed additive comprises a formulating agent and one or more polypeptides any of the second to the twenty-eighth aspect of the invention. In a further embodiment, the formulating agent comprises one or more of the following compounds: glycerol, ethylene glycol, 1,2-propylene glycol or 1,3-propylene glycol, sodium chloride, sodium benzoate, potassium sorbate, sodium sulfate, potassium sulfate, magnesium sulfate, sodium thiosulfate, calcium carbonate, sodium citrate, dextrin, glucose, sucrose, sorbitol, lactose, starch and cellulose.

In an embodiment, the animal feed or animal feed additive comprises one or more additional enzymes. In a preferred embodiment, the animal feed or animal feed additive further comprises one or more GH10 or GH11 polypeptides having xylanase activity. In an embodiment, the animal feed or animal feed additive comprises one or more microbes. In an embodiment, the animal feed or animal feed additive comprises one or more vitamins. In an embodiment, the animal feed or animal feed additive comprises one or more minerals. In an embodiment, the animal feed or animal feed additive comprises one or more amino acids. In a further embodiment, the animal feed or animal feed additive further comprises one or more formulating agents and one or more components selected from the list consisting of: one or more additional enzymes; one or more microbes; one or more vitamins; one or more minerals; one or more amino acids; and one or more other feed ingredients.

The present invention also relates to an animal feed or an animal feed additive comprising a polypeptide having xylanase activity and having at least 80% sequence identity, e.g., at least 85%, at least 86%, at least 87%, at least 88%, at least 89%, at least 90%, at least 91%, at least 92%, at least 93%, at least 94%, at least 95%, at least 96%, at least 97%, at least 98% or at least 99% to the polypeptide of SEQ ID NO: 71. In one embodiment, the polypeptides differ by up to 25 amino acids, e.g., between 1 and 25 amino acids, such as 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24 or 25 amino acids from SEQ ID NO: 71. In an embodiment, the animal feed or animal feed additive further comprises a formulating agent as described in the formulating agent section above. In a further embodiment, the formulating agent comprises one or more of the following compounds: glycerol, ethylene glycol, 1,2-propylene glycol or 1,3-propylene glycol, sodium chloride, sodium benzoate, potassium sorbate, sodium sulfate, potassium sulfate, magnesium sulfate, sodium thiosulfate, calcium carbonate, sodium citrate, dextrin, glucose, sucrose, sorbitol, lactose, starch and cellulose. In an embodiment, the animal feed or animal feed additive comprises one or more additional enzymes. In a preferred embodiment, the animal feed or animal feed additive further comprises one or more GH62 polypeptides having arabinofuranosidase activity. In an embodiment, the animal feed or animal feed additive comprises one or more microbes. In an embodiment, the animal feed or animal feed additive comprises one or more vitamins. In an embodiment, the animal feed or animal feed additive comprises one or more minerals. In an embodiment, the animal feed or animal feed additive comprises one or more amino acids. In a further embodiment, the animal feed or animal feed additive further comprises one or more formulating agents and one or more components selected from the list consisting of: one or more additional enzymes; one or more microbes; one or more vitamins; one or more minerals; one or more amino acids; and one or more other feed ingredients.

In one embodiment, the animal feed or an animal feed additive comprises a polypeptide comprising or consisting of the amino acid sequence of SEQ ID NO: 71 or an allelic variant thereof; or is a fragment thereof having xylanase activity and having at least 90% such as at least 91%, at least 92%, at least 93%, at least 94%, at least 95%, at least 96%, at least 97%, at least 98% or at least 99% of the length of the polypeptide. In another embodiment, animal feed or an animal feed additive comprises a polypeptide comprising or consisting of amino acids 1 to 288 of SEQ ID NO: 71.

In another embodiment, the animal feed or an animal feed additive comprises a variant polypeptide having xylanase activity wherein the polypeptide is a variant of SEQ ID NO: 71 comprising one or more amino acid substitutions, and/or one or more amino acid deletions, and/or one or more amino acid insertions or any combination thereof in 1, 2, 3, 4, 5, 6, 7, 8, 9, 10, 11, 12, 13, 14, 15, 16, 17, 18, 19, 20, 21, 22, 23, 24 or 25 positions. In an embodiment, the number of positions comprising one or more amino acid substitutions, and/or one or more amino acid deletions, and/or one or more amino acid insertions or any combination thereof in SEQ ID NO: 71 is not more than 10, e.g., 1, 2, 3, 4, 5, 6, 7, 8, 9 or 10. In another embodiment, the number of substitutions, deletions, and/or insertions in SEQ ID NO: 71 is not more than 10, e.g., 1, 2, 3, 4, 5, 6, 7, 8, 9 or 10. In a further embodiment, the number of substitutions, preferably conservative substitutions, in SEQ ID NO: 71 is not more than 10, e.g., 1, 2, 3, 4, 5, 6, 7, 8, 9 or 10. Examples of amino acid changes and conservative substitutions are described in the second aspect of the invention.

The present invention also relates to an animal feed or an animal feed additive comprising a polypeptide having xylanase activity and having at least 80% sequence identity, e.g., at least 85%, at least 86%, at least 87%, at least 88%, at least 89%, at least 90%, at least 91%, at least 92%, at least 93%, at least 94%, at least 95%, at least 96%, at least 97%, at least 98% or at least 99% to the polypeptide of SEQ ID NO: 78. In one embodiment, the polypeptides differ by up to 25 amino acids, e.g., between 1 and 25 amino acids, such as 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24 or 25 amino acids from SEQ ID NO: 78. In an embodiment, the animal feed or animal feed additive further comprises a formulating agent as described in the formulating agent section above. In a further embodiment, the formulating agent comprises one or more of the following compounds: glycerol, ethylene glycol, 1,2-propylene glycol or 1,3-propylene glycol, sodium chloride, sodium benzoate, potassium sorbate, sodium sulfate, potassium sulfate, magnesium sulfate, sodium thiosulfate, calcium carbonate, sodium citrate, dextrin, glucose, sucrose, sorbitol, lactose, starch and cellulose. In an embodiment, the animal feed or animal feed additive comprises one or more additional enzymes. In a preferred embodiment, the animal feed or animal feed additive further comprises one or more GH62 polypeptides having arabinofuranosidase activity. In an embodiment, the animal feed or animal feed additive comprises one or more microbes. In an embodiment, the animal feed or animal feed additive comprises one or more vitamins. In an embodiment, the animal feed or animal feed additive comprises one or more minerals. In an embodiment, the animal feed or animal feed additive comprises one or more amino acids. In a further embodiment, the animal feed or animal feed additive further comprises one or more formulating agents and one or more components selected from the list consisting of: one or more additional enzymes; one or more microbes; one or more vitamins; one or more minerals; one or more amino acids; and one or more other feed ingredients.

In one embodiment, the animal feed or an animal feed additive comprises a polypeptide comprising or consisting of the amino acid sequence of SEQ ID NO: 78 or an allelic variant thereof; or is a fragment thereof having xylanase activity and having at least 90% such as at least 91%, at least 92%, at least 93%, at least 94%, at least 95%, at least 96%, at least 97%, at least 98% or at least 99% of the length of the polypeptide. In another embodiment, animal feed or an animal feed additive comprises a polypeptide comprising or consisting of amino acids 1 to 183 of SEQ ID NO: 78. In another embodiment, animal feed or an animal feed additive comprises a polypeptide comprising or consisting of amino acids 1 to 181 of SEQ ID NO: 81.

In another embodiment, the animal feed or an animal feed additive comprises a variant polypeptide having xylanase activity wherein the polypeptide is a variant of SEQ ID NO: 78 comprising one or more amino acid substitutions, and/or one or more amino acid deletions, and/or one or more amino acid insertions or any combination thereof in 1, 2, 3, 4, 5, 6, 7, 8, 9, 10, 11, 12, 13, 14, 15, 16, 17, 18, 19, 20, 21, 22, 23, 24 or 25 positions. In an embodiment, the number of positions comprising one or more amino acid substitutions, and/or one or more amino acid deletions, and/or one or more amino acid insertions or any combination thereof in SEQ ID NO: 78 is not more than 10, e.g., 1, 2, 3, 4, 5, 6, 7, 8, 9 or 10. In another embodiment, the number of substitutions, deletions, and/or insertions in SEQ ID NO: 78 is not more than 10, e.g., 1, 2, 3, 4, 5, 6, 7, 8, 9 or 10. In a further embodiment, the number of substitutions, preferably conservative substitutions, in SEQ ID NO: 78 is not more than 10, e.g., 1, 2, 3, 4, 5, 6, 7, 8, 9 or 10. Examples of amino acid changes and conservative substitutions are described in the second aspect of the invention.

The present invention also relates to an animal feed or an animal feed additive comprising a polypeptide having xylanase activity and having at least 80% sequence identity, e.g., at least 85%, at least 86%, at least 87%, at least 88%, at least 89%, at least 90%, at least 91%, at least 92%, at least 93%, at least 94%, at least 95%, at least 96%, at least 97%, at least 98% or at least 99% to the polypeptide of SEQ ID NO: 177. In one embodiment, the polypeptides differ by up to 25 amino acids, e.g., between 1 and 25 amino acids, such as 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24 or 25 amino acids from SEQ ID NO: 177. In an embodiment, the animal feed or animal feed additive further comprises a formulating agent as described in the formulating agent section above. In a further embodiment, the formulating agent comprises one or more of the following compounds: glycerol, ethylene glycol, 1,2-propylene glycol or 1,3-propylene glycol, sodium chloride, sodium benzoate, potassium sorbate, sodium sulfate, potassium sulfate, magnesium sulfate, sodium thiosulfate, calcium carbonate, sodium citrate, dextrin, glucose, sucrose, sorbitol, lactose, starch and cellulose. In an embodiment, the animal feed or animal feed additive comprises one or more additional enzymes. In a preferred embodiment, the animal feed or animal feed additive further comprises one or more GH62 polypeptides having arabinofuranosidase activity. In an embodiment, the animal feed or animal feed additive comprises one or more microbes. In an embodiment, the animal feed or animal feed additive comprises one or more vitamins. In an embodiment, the animal feed or animal feed additive comprises one or more minerals. In an embodiment, the animal feed or animal feed additive comprises one or more amino acids. In a further embodiment, the animal feed or animal feed additive further comprises one or more formulating agents and one or more components selected from the list consisting of: one or more additional enzymes; one or more microbes; one or more vitamins; one or more minerals; one or more amino acids; and one or more other feed ingredients.

In one embodiment, the animal feed or an animal feed additive comprises a polypeptide comprising or consisting of the amino acid sequence of SEQ ID NO: 177 or an allelic variant thereof; or is a fragment thereof having xylanase activity and having at least 90% such as at least 91%, at least 92%, at least 93%, at least 94%, at least 95%, at least 96%, at least 97%, at least 98% or at least 99% of the length of the polypeptide. In another embodiment, animal feed or an animal feed additive comprises a polypeptide comprising or consisting of amino acids 1 to 323 of SEQ ID NO: 177. In another embodiment, animal feed or an animal feed additive comprises a polypeptide comprising or consisting of amino acids 1 to 331 of SEQ ID NO: 180.

In another embodiment, the animal feed or animal feed additive comprises a variant polypeptide having xylanase activity wherein the polypeptide is a variant of SEQ ID NO: 177 comprising one or more amino acid substitutions, and/or one or more amino acid deletions, and/or one or more amino acid insertions or any combination thereof in 1, 2, 3, 4, 5, 6, 7, 8, 9, 10, 11, 12, 13, 14, 15, 16, 17, 18, 19, 20, 21, 22, 23, 24 or 25 positions. In an embodiment, the number of positions comprising one or more amino acid substitutions, and/or one or more amino acid deletions, and/or one or more amino acid insertions or any combination thereof in SEQ ID NO: 177 is not more than 10, e.g., 1, 2, 3, 4, 5, 6, 7, 8, 9 or 10. In another embodiment, the number of substitutions, deletions, and/or insertions in SEQ ID NO: 177 is not more than 10, e.g., 1, 2, 3, 4, 5, 6, 7, 8, 9 or 10. In a further embodiment, the number of substitutions, preferably conservative substitutions, in SEQ ID NO: 177 is not more than 10, e.g., 1, 2, 3, 4, 5, 6, 7, 8, 9 or 10. Examples of amino acid changes and conservative substitutions are described in the second aspect of the invention.

The present invention also relates to an animal feed or an animal feed additive comprising a polypeptide having arabinofuranosidase activity and having at least 80% sequence identity, e.g., at least 85%, at least 86%, at least 87%, at least 88%, at least 89%, at least 90%, at least 91%, at least 92%, at least 93%, at least 94%, at least 95%, at least 96%, at least 97%, at least 98% or at least 99% to the polypeptide of SEQ ID NO: 15. In one embodiment, the polypeptides differ by up to 25 amino acids, e.g., between 1 and 25 amino acids, such as 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24 or 25 amino acids from SEQ ID NO: 15. In an embodiment, the animal feed or animal feed additive further comprises a formulating agent as described in the formulating agent section above. In a further embodiment, the formulating agent comprises one or more of the following compounds: glycerol, ethylene glycol, 1,2-propylene glycol or 1,3-propylene glycol, sodium chloride, sodium benzoate, potassium sorbate, sodium sulfate, potassium sulfate, magnesium sulfate, sodium thiosulfate, calcium carbonate, sodium citrate, dextrin, glucose, sucrose, sorbitol, lactose, starch and cellulose. In an embodiment, the animal feed or animal feed additive comprises one or more additional enzymes. In a preferred embodiment, the animal feed or animal feed additive further comprises one or more GH10 or GH11 polypeptides having xylanase activity. In an embodiment, the animal feed or animal feed additive comprises one or more microbes. In an embodiment, the animal feed or animal feed additive comprises one or more vitamins. In an embodiment, the animal feed or animal feed additive comprises one or more minerals. In an embodiment, the animal feed or animal feed additive comprises one or more amino acids. In a further embodiment, the animal feed or animal feed additive further comprises one or more formulating agents and one or more components selected from the list consisting of: one or more additional enzymes; one or more microbes; one or more vitamins; one or more minerals; one or more amino acids; and one or more other feed ingredients.

In one embodiment, the animal feed or an animal feed additive comprises a polypeptide comprising or consisting of the amino acid sequence of SEQ ID NO: 15 or an allelic variant thereof; or is a fragment thereof having arabinofuranosidase activity and having at least 90% such as at least 91%, at least 92%, at least 93%, at least 94%, at least 95%, at least 96%, at least 97%, at least 98% or at least 99% of the length of the polypeptide. In another embodiment, animal feed or an animal feed additive comprises a polypeptide comprising or consisting of amino acids 1 to 323 of SEQ ID NO: 15. In another embodiment, animal feed or an animal feed additive comprises a polypeptide comprising or consisting of amino acids 1 to 331 of SEQ ID NO: 180.

In another embodiment, the animal feed or an animal feed additive comprises a variant polypeptide having arabinofuranosidase activity wherein the polypeptide is a variant of SEQ ID NO: 15 comprising one or more amino acid substitutions, and/or one or more amino acid deletions, and/or one or more amino acid insertions or any combination thereof in 1, 2, 3, 4, 5, 6, 7, 8, 9, 10, 11, 12, 13, 14, 15, 16, 17, 18, 19, 20, 21, 22, 23, 24 or 25 positions. In an embodiment, the number of positions comprising one or more amino acid substitutions, and/or one or more amino acid deletions, and/or one or more amino acid insertions or any combination thereof in SEQ ID NO: 15 is not more than 10, e.g., 1, 2, 3, 4, 5, 6, 7, 8, 9 or 10. In another embodiment, the number of substitutions, deletions, and/or insertions in SEQ ID NO: 15 is not more than 10, e.g., 1, 2, 3, 4, 5, 6, 7, 8, 9 or 10. In a further embodiment, the number of substitutions, preferably conservative substitutions, in SEQ ID NO: 15 is not more than 10, e.g., 1, 2, 3, 4, 5, 6, 7, 8, 9 or 10. Examples of amino acid changes and conservative substitutions are described in the second aspect of the invention.

The present invention also relates to an animal feed or an animal feed additive comprising a polypeptide having arabinofuranosidase activity and having at least 80% sequence identity, e.g., at least 85%, at least 86%, at least 87%, at least 88%, at least 89%, at least 90%, at least 91%, at least 92%, at least 93%, at least 94%, at least 95%, at least 96%, at least 97%, at least 98% or at least 99% to the polypeptide of SEQ ID NO: 18. In one embodiment, the polypeptides differ by up to 25 amino acids, e.g., between 1 and 25 amino acids, such as 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24 or 25 amino acids from SEQ ID NO: 18. In an embodiment, the animal feed or animal feed additive further comprises a formulating agent as described in the formulating agent section above. In a further embodiment, the formulating agent comprises one or more of the following compounds: glycerol, ethylene glycol, 1,2-propylene glycol or 1,3-propylene glycol, sodium chloride, sodium benzoate, potassium sorbate, sodium sulfate, potassium sulfate, magnesium sulfate, sodium thiosulfate, calcium carbonate, sodium citrate, dextrin, glucose, sucrose, sorbitol, lactose, starch and cellulose. In an embodiment, the animal feed or animal feed additive comprises one or more additional enzymes. In a preferred embodiment, the animal feed or animal feed additive further comprises one or more GH10 or GH11 polypeptides having xylanase activity. In an embodiment, the animal feed or animal feed additive comprises one or more microbes. In an embodiment, the animal feed or animal feed additive comprises one or more vitamins. In an embodiment, the animal feed or animal feed additive comprises one or more minerals. In an embodiment, the animal feed or animal feed additive comprises one or more amino acids. In a further embodiment, the animal feed or animal feed additive further comprises one or more formulating agents and one or more components selected from the list consisting of: one or more additional enzymes; one or more microbes; one or more vitamins; one or more minerals; one or more amino acids; and one or more other feed ingredients.

In one embodiment, the animal feed or an animal feed additive comprises a polypeptide comprising or consisting of the amino acid sequence of SEQ ID NO: 18 or an allelic variant thereof; or is a fragment thereof having arabinofuranosidase activity and having at least 90% such as at least 91%, at least 92%, at least 93%, at least 94%, at least 95%, at least 96%, at least 97%, at least 98% or at least 99% of the length of the polypeptide. In another embodiment, animal feed or an animal feed additive comprises a polypeptide comprising or consisting of amino acids 1 to 323 of SEQ ID NO: 18. In another embodiment, animal feed or an animal feed additive comprises a polypeptide comprising or consisting of amino acids 1 to 331 of SEQ ID NO: 180.

In another embodiment, the animal feed or an animal feed additive comprises a variant polypeptide having arabinofuranosidase activity wherein the polypeptide is a variant of SEQ ID NO: 18 comprising one or more amino acid substitutions, and/or one or more amino acid deletions, and/or one or more amino acid insertions or any combination thereof in 1, 2, 3, 4, 5, 6, 7, 8, 9, 10, 11, 12, 13, 14, 15, 16, 17, 18, 19, 20, 21, 22, 23, 24 or 25 positions. In an embodiment, the number of positions comprising one or more amino acid substitutions, and/or one or more amino acid deletions, and/or one or more amino acid insertions or any combination thereof in SEQ ID NO: 18 is not more than 10, e.g., 1, 2, 3, 4, 5, 6, 7, 8, 9 or 10. In another embodiment, the number of substitutions, deletions, and/or insertions in SEQ ID NO: 18 is not more than 10, e.g., 1, 2, 3, 4, 5, 6, 7, 8, 9 or 10. In a further embodiment, the number of substitutions, preferably conservative substitutions, in SEQ ID NO: 18 is not more than 10, e.g., 1, 2, 3, 4, 5, 6, 7, 8, 9 or 10. Examples of amino acid changes and conservative substitutions are described in the second aspect of the invention.

The present invention also relates to an animal feed or an animal feed additive comprising a polypeptide having arabinofuranosidase activity and having at least 80% sequence identity, e.g., at least 85%, at least 86%, at least 87%, at least 88%, at least 89%, at least 90%, at least 91%, at least 92%, at least 93%, at least 94%, at least 95%, at least 96%, at least 97%, at least 98% or at least 99% to the polypeptide of SEQ ID NO: 21. In one embodiment, the polypeptides differ by up to 25 amino acids, e.g., between 1 and 25 amino acids, such as 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24 or 25 amino acids from SEQ ID NO: 21. In an embodiment, the animal feed or animal feed additive further comprises a formulating agent as described in the formulating agent section above. In a further embodiment, the formulating agent comprises one or more of the following compounds: glycerol, ethylene glycol, 1,2-propylene glycol or 1,3-propylene glycol, sodium chloride, sodium benzoate, potassium sorbate, sodium sulfate, potassium sulfate, magnesium sulfate, sodium thiosulfate, calcium carbonate, sodium citrate, dextrin, glucose, sucrose, sorbitol, lactose, starch and cellulose. In an embodiment, the animal feed or animal feed additive comprises one or more additional enzymes. In a preferred embodiment, the animal feed or animal feed additive further comprises one or more GH10 or GH11 polypeptides having xylanase activity. In an embodiment, the animal feed or animal feed additive comprises one or more microbes. In an embodiment, the animal feed or animal feed additive comprises one or more vitamins. In an embodiment, the animal feed or animal feed additive comprises one or more minerals. In an embodiment, the animal feed or animal feed additive comprises one or more amino acids. In a further embodiment, the animal feed or animal feed additive further comprises one or more formulating agents and one or more components selected from the list consisting of: one or more additional enzymes;

one or more microbes; one or more vitamins; one or more minerals; one or more amino acids; and one or more other feed ingredients.

In one embodiment, the animal feed or an animal feed additive comprises a polypeptide comprising or consisting of the amino acid sequence of SEQ ID NO: 21 or an allelic variant thereof; or is a fragment thereof having arabinofuranosidase activity and having at least 90% such as at least 91%, at least 92%, at least 93%, at least 94%, at least 95%, at least 96%, at least 97%, at least 98% or at least 99% of the length of the polypeptide. In another embodiment, animal feed or an animal feed additive comprises a polypeptide comprising or consisting of amino acids 1 to 323 of SEQ ID NO: 21. In another embodiment, animal feed or an animal feed additive comprises a polypeptide comprising or consisting of amino acids 1 to 331 of SEQ ID NO: 180.

In another embodiment, the animal feed or an animal feed additive comprises a variant polypeptide having arabinofuranosidase activity wherein the polypeptide is a variant of SEQ ID NO: 21 comprising one or more amino acid substitutions, and/or one or more amino acid deletions, and/or one or more amino acid insertions or any combination thereof in 1, 2, 3, 4, 5, 6, 7, 8, 9, 10, 11, 12, 13, 14, 15, 16, 17, 18, 19, 20, 21, 22, 23, 24 or 25 positions. In an embodiment, the number of positions comprising one or more amino acid substitutions, and/or one or more amino acid deletions, and/or one or more amino acid insertions or any combination thereof in SEQ ID NO: 21 is not more than 10, e.g., 1, 2, 3, 4, 5, 6, 7, 8, 9 or 10. In another embodiment, the number of substitutions, deletions, and/or insertions in SEQ ID NO: 21 is not more than 10, e.g., 1, 2, 3, 4, 5, 6, 7, 8, 9 or 10. In a further embodiment, the number of substitutions, preferably conservative substitutions, in SEQ ID NO: 21 is not more than 10, e.g., 1, 2, 3, 4, 5, 6, 7, 8, 9 or 10. Examples of amino acid changes and conservative substitutions are described in the second aspect of the invention.

The present invention also relates to an animal feed or an animal feed additive comprising a polypeptide having arabinofuranosidase activity and having at least 80% sequence identity, e.g., at least 85%, at least 86%, at least 87%, at least 88%, at least 89%, at least 90%, at least 91%, at least 92%, at least 93%, at least 94%, at least 95%, at least 96%, at least 97%, at least 98% or at least 99% to the polypeptide of SEQ ID NO: 42. In one embodiment, the polypeptides differ by up to 25 amino acids, e.g., between 1 and 25 amino acids, such as 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24 or 25 amino acids from SEQ ID NO: 42. In an embodiment, the animal feed or animal feed additive further comprises a formulating agent as described in the formulating agent section above. In a further embodiment, the formulating agent comprises one or more of the following compounds: glycerol, ethylene glycol, 1,2-propylene glycol or 1,3-propylene glycol, sodium chloride, sodium benzoate, potassium sorbate, sodium sulfate, potassium sulfate, magnesium sulfate, sodium thiosulfate, calcium carbonate, sodium citrate, dextrin, glucose, sucrose, sorbitol, lactose, starch and cellulose. In an embodiment, the animal feed or animal feed additive comprises one or more additional enzymes. In a preferred embodiment, the animal feed or animal feed additive further comprises one or more GH10 or GH11 polypeptides having xylanase activity. In an embodiment, the animal feed or animal feed additive comprises one or more microbes. In an embodiment, the animal feed or animal feed additive comprises one or more vitamins. In an embodiment, the animal feed or animal feed additive comprises one or more minerals. In an embodiment, the animal feed or animal feed additive comprises one or more amino acids. In a further embodiment, the animal feed or animal feed additive further comprises one or more formulating agents and one or more components selected from the list consisting of: one or more additional enzymes; one or more microbes; one or more vitamins; one or more minerals; one or more amino acids; and one or more other feed ingredients.

In one embodiment, the animal feed or an animal feed additive comprises a polypeptide comprising or consisting of the amino acid sequence of SEQ ID NO: 42 or an allelic variant thereof; or is a fragment thereof having arabinofuranosidase activity and having at least 90% such as at least 91%, at least 92%, at least 93%, at least 94%, at least 95%, at least 96%, at least 97%, at least 98% or at least 99% of the length of the polypeptide. In another embodiment, animal feed or an animal feed additive comprises a polypeptide comprising or consisting of amino acids 1 to 323 of SEQ ID NO: 42. In another embodiment, animal feed or an animal feed additive comprises a polypeptide comprising or consisting of amino acids 1 to 331 of SEQ ID NO: 180.

In another embodiment, the animal feed or an animal feed additive comprises a variant polypeptide having arabinofuranosidase activity wherein the polypeptide is a variant of SEQ ID NO: 42 comprising one or more amino acid substitutions, and/or one or more amino acid deletions, and/or one or more amino acid insertions or any combination thereof in 1, 2, 3, 4, 5, 6, 7, 8, 9, 10, 11, 12, 13, 14, 15, 16, 17, 18, 19, 20, 21, 22, 23, 24 or 25 positions. In an embodiment, the number of positions comprising one or more amino acid substitutions, and/or one or more amino acid deletions, and/or one or more amino acid insertions or any combination thereof in SEQ ID NO: 42 is not more than 10, e.g., 1, 2, 3, 4, 5, 6, 7, 8, 9 or 10. In another embodiment, the number of substitutions, deletions, and/or insertions in SEQ ID NO: 42 is not more than 10, e.g., 1, 2, 3, 4, 5, 6, 7, 8, 9 or 10. In a further embodiment, the number of substitutions, preferably conservative substitutions, in SEQ ID NO: 42 is not more than 10, e.g., 1, 2, 3, 4, 5, 6, 7, 8, 9 or 10. Examples of amino acid changes and conservative substitutions are described in the second aspect of the invention.

The present invention also relates to an animal feed or an animal feed additive comprising a polypeptide having arabinofuranosidase activity and having at least 80% sequence identity, e.g., at least 85%, at least 86%, at least 87%, at least 88%, at least 89%, at least 90%, at least 91%, at least 92%, at least 93%, at least 94%, at least 95%, at least 96%, at least 97%, at least 98% or at least 99% to the polypeptide of SEQ ID NO: 132. In one embodiment, the polypeptides differ by up to 25 amino acids, e.g., between 1 and 25 amino acids, such as 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24 or 25 amino acids from SEQ ID NO: 132. In an embodiment, the animal feed or animal feed additive further comprises a formulating agent as described in the formulating agent section above. In a further embodiment, the formulating agent comprises one or more of the following compounds: glycerol, ethylene glycol, 1,2-propylene glycol or 1,3-propylene glycol, sodium chloride, sodium benzoate, potassium sorbate, sodium sulfate, potassium sulfate, magnesium sulfate, sodium thiosulfate, calcium carbonate, sodium citrate, dextrin, glucose, sucrose, sorbitol, lactose, starch and cellulose. In an embodiment, the animal feed or animal feed additive comprises one or more additional enzymes. In a preferred embodiment, the animal feed or animal feed additive further comprises one or more GH10 or GH11 polypeptides having xylanase activity. In an embodiment, the animal feed or animal feed additive comprises one or more microbes. In an embodiment, the animal feed or animal feed additive comprises one or more vitamins. In an embodiment, the animal feed or animal feed additive comprises one or more minerals. In an embodiment, the animal feed or animal feed additive comprises one or more amino acids. In a further embodiment, the animal feed or animal feed additive further comprises one or more formulating agents and one or more components selected from the list consisting of: one or more additional enzymes; one or more microbes; one or more vitamins; one or more minerals; one or more amino acids; and one or more other feed ingredients.

In one embodiment, the animal feed or an animal feed additive comprises a polypeptide comprising or consisting of the amino acid sequence of SEQ ID NO: 132 or an allelic variant thereof; or is a fragment thereof having arabinofuranosidase activity and having at least 90% such as at least 91%, at least 92%, at least 93%, at least 94%, at least 95%, at least 96%, at least 97%, at least 98% or at least 99% of the length of the polypeptide. In another embodiment, animal feed or an animal feed additive comprises a polypeptide comprising or consisting of amino acids 1 to 323 of SEQ ID NO: 132. In another embodiment, animal feed or an animal feed additive comprises a polypeptide comprising or consisting of amino acids 1 to 331 of SEQ ID NO: 180.

In another embodiment, the animal feed or an animal feed additive comprises a variant polypeptide having arabinofuranosidase activity wherein the polypeptide is a variant of SEQ ID NO: 132 comprising one or more amino acid substitutions, and/or one or more amino acid deletions, and/or one or more amino acid insertions or any combination thereof in 1, 2, 3, 4, 5, 6, 7, 8, 9, 10, 11, 12, 13, 14, 15, 16, 17, 18, 19, 20, 21, 22, 23, 24 or 25 positions. In an embodiment, the number of positions comprising one or more amino acid substitutions, and/or one or more amino acid deletions, and/or one or more amino acid insertions or any combination thereof in SEQ ID NO: 132 is not more than 10, e.g., 1, 2, 3, 4, 5, 6, 7, 8, 9 or 10. In another embodiment, the number of substitutions, deletions, and/or insertions in SEQ ID NO: 132 is not more than 10, e.g., 1, 2, 3, 4, 5, 6, 7, 8, 9 or 10. In a further embodiment, the number of substitutions, preferably conservative substitutions, in SEQ ID NO: 132 is not more than 10, e.g., 1, 2, 3, 4, 5, 6, 7, 8, 9 or 10. Examples of amino acid changes and conservative substitutions are described in the second aspect of the invention.

The present invention also relates to an animal feed or an animal feed additive comprising a polypeptide having arabinofuranosidase activity and having at least 80% sequence identity, e.g., at least 85%, at least 86%, at least 87%, at least 88%, at least 89%, at least 90%, at least 91%, at least 92%, at least 93%, at least 94%, at least 95%, at least 96%, at least 97%, at least 98% or at least 99% to the polypeptide of SEQ ID NO: 150. In one embodiment, the polypeptides differ by up to 25 amino acids, e.g., between 1 and 25 amino acids, such as 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24 or 25 amino acids from SEQ ID NO: 150. In an embodiment, the animal feed or animal feed additive further comprises a formulating agent as described in the formulating agent section above. In a further embodiment, the formulating agent comprises one or more of the following compounds: glycerol, ethylene glycol, 1,2-propylene glycol or 1,3-propylene glycol, sodium chloride, sodium benzoate, potassium sorbate, sodium sulfate, potassium sulfate, magnesium sulfate, sodium thiosulfate, calcium carbonate, sodium citrate, dextrin, glucose, sucrose, sorbitol, lactose, starch and cellulose. In an embodiment, the animal feed or animal feed additive comprises one or more additional enzymes. In a preferred embodiment, the animal feed or animal feed additive further comprises one or more GH10 or GH11 polypeptides having xylanase activity. In an embodiment, the animal feed or animal feed additive comprises one or more microbes. In an embodiment, the animal feed or animal feed additive comprises one or more vitamins. In an embodiment, the animal feed or animal feed additive comprises one or more minerals. In an embodiment, the animal feed or animal feed additive comprises one or more amino acids. In a further embodiment, the animal feed or animal feed additive further comprises one or more formulating agents and one or more components selected from the list consisting of: one or more additional enzymes; one or more microbes; one or more vitamins; one or more minerals; one or more amino acids; and one or more other feed ingredients.

In one embodiment, the animal feed or an animal feed additive comprises a polypeptide comprising or consisting of the amino acid sequence of SEQ ID NO: 150 or an allelic variant thereof; or is a fragment thereof having arabinofuranosidase activity and having at least 90% such as at least 91%, at least 92%, at least 93%, at least 94%, at least 95%, at least 96%, at least 97%, at least 98% or at least 99% of the length of the polypeptide. In another embodiment, animal feed or an animal feed additive comprises a polypeptide comprising or consisting of amino acids 1 to 323 of SEQ ID NO: 150. In another embodiment, animal feed or an animal feed additive comprises a polypeptide comprising or consisting of amino acids 1 to 331 of SEQ ID NO: 180.

In another embodiment, the animal feed or an animal feed additive comprises a variant polypeptide having arabinofuranosidase activity wherein the polypeptide is a variant of SEQ ID NO: 150 comprising one or more amino acid substitutions, and/or one or more amino acid deletions, and/or one or more amino acid insertions or any combination thereof in 1, 2, 3, 4, 5, 6, 7, 8, 9, 10, 11, 12, 13, 14, 15, 16, 17, 18, 19, 20, 21, 22, 23, 24 or 25 positions. In an embodiment, the number of positions comprising one or more amino acid substitutions, and/or one or more amino acid deletions, and/or one or more amino acid insertions or any combination thereof in SEQ ID NO: 150 is not more than 10, e.g., 1, 2, 3, 4, 5, 6, 7, 8, 9 or 10. In another embodiment, the number of substitutions, deletions, and/or insertions in SEQ ID NO: 150 is not more than 10, e.g., 1, 2, 3, 4, 5, 6, 7, 8, 9 or 10. In a further embodiment, the number of substitutions, preferably conservative substitutions, in SEQ ID NO: 150 is not more than 10, e.g., 1, 2, 3, 4, 5, 6, 7, 8, 9 or 10. Examples of amino acid changes and conservative substitutions are described in the second aspect of the invention.

The present invention also relates to an animal feed or an animal feed additive comprising a polypeptide having arabinofuranosidase activity and having at least 80% sequence identity, e.g., at least 85%, at least 86%, at least 87%, at least 88%, at least 89%, at least 90%, at least 91%, at least 92%, at least 93%, at least 94%, at least 95%, at least 96%, at least 97%, at least 98% or at least 99% to the polypeptide of SEQ ID NO: 159. In one embodiment, the polypeptides differ by up to 25 amino acids, e.g., between 1 and 25 amino acids, such as 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24 or 25 amino acids from SEQ ID NO: 159. In an embodiment, the animal feed or animal feed additive further comprises a formulating agent as described in the formulating agent section above. In a further embodiment, the formulating agent comprises one or more of the following compounds: glycerol, ethylene glycol, 1,2-propylene glycol or 1,3-propylene glycol, sodium chloride, sodium benzoate, potassium sorbate, sodium sulfate, potassium sulfate, magnesium sulfate, sodium thiosulfate, calcium carbonate, sodium citrate, dextrin, glucose, sucrose, sorbitol, lactose, starch and cellulose. In an embodiment, the animal feed or animal feed additive comprises one or more additional enzymes. In a preferred embodiment, the animal feed or animal feed additive further comprises one or more GH10 or GH11 polypeptides having xylanase activity. In an embodiment, the animal feed or animal feed additive comprises one or more microbes. In an embodiment, the animal feed or animal feed additive comprises one or more vitamins. In an embodiment, the animal feed or animal feed additive comprises one or more minerals. In an embodiment, the animal feed or animal feed additive comprises one or more amino acids. In a further embodiment, the animal feed or animal feed additive further comprises one or more formulating agents and one or more components selected from the list consisting of: one or more additional enzymes; one or more microbes; one or more vitamins; one or more minerals; one or more amino acids; and one or more other feed ingredients.

In one embodiment, the animal feed or an animal feed additive comprises a polypeptide comprising or consisting of the amino acid sequence of SEQ ID NO: 159 or an allelic variant thereof; or is a fragment thereof having arabinofuranosidase activity and having at least 90% such as at least 91%, at least 92%, at least 93%, at least 94%, at least 95%, at least 96%, at least 97%, at least 98% or at least 99% of the length of the polypeptide. In another embodiment, animal feed or an animal feed additive comprises a polypeptide comprising or consisting of amino acids 1 to 323 of SEQ ID NO: 159. In another embodiment, animal feed or an animal feed additive comprises a polypeptide comprising or consisting of amino acids 1 to 331 of SEQ ID NO: 180.

In another embodiment, the animal feed or an animal feed additive comprises a variant polypeptide having arabinofuranosidase activity wherein the polypeptide is a variant of SEQ ID NO: 159 comprising one or more amino acid substitutions, and/or one or more amino acid deletions, and/or one or more amino acid insertions or any combination thereof in 1, 2, 3, 4, 5, 6, 7, 8, 9, 10, 11, 12, 13, 14, 15, 16, 17, 18, 19, 20, 21, 22, 23, 24 or 25 positions. In an embodiment, the number of positions comprising one or more amino acid substitutions, and/or one or more amino acid deletions, and/or one or more amino acid insertions or any combination thereof in SEQ ID NO: 159 is not more than 10, e.g., 1, 2, 3, 4, 5, 6, 7, 8, 9 or 10. In another embodiment, the number of substitutions, deletions, and/or insertions in SEQ ID NO: 159 is not more than 10, e.g., 1, 2, 3, 4, 5, 6, 7, 8, 9 or 10. In a further embodiment, the number of substitutions, preferably conservative substitutions, in SEQ ID NO: 159 is not more than 10, e.g., 1, 2, 3, 4, 5, 6, 7, 8, 9 or 10. Examples of amino acid changes and conservative substitutions are described in the second aspect of the invention.

Animal feed compositions or diets have a relatively high content of protein. Poultry and pig diets can be characterised as indicated in Table B of WO 01/58275, columns 2-3. Fish diets can be characterised as indicated in column 4 of this Table B. Furthermore such fish diets usually have a crude fat content of 200-310 g/kg.

An animal feed composition according to the invention has a crude protein content of 50-800 g/kg, and furthermore comprises at least one xylanase as claimed herein and/or at least one arabinofuranosidase as claimed herein.

Furthermore, or in the alternative (to the crude protein content indicated above), the animal feed composition of the invention has a content of metabolisable energy of 10-30 MJ/kg; and/or a content of calcium of 0.1-200 g/kg; and/or a content of available phosphorus of 0.1-200 g/kg; and/or a content of methionine of 0.1-100 g/kg; and/or a content of methionine plus cysteine of 0.1-150 g/kg; and/or a content of lysine of 0.5-50 g/kg.

In particular embodiments, the content of metabolisable energy, crude protein, calcium, phosphorus, methionine, methionine plus cysteine, and/or lysine is within any one of ranges 2, 3, 4 or 5 in Table B of WO 01/58275 (R. 2-5).

Crude protein is calculated as nitrogen (N) multiplied by a factor 6.25, i.e. Crude protein (g/kg)=N (g/kg)×6.25. The nitrogen content is determined by the Kjeldahl method (A.O.A.C., 1984, Official Methods of Analysis 14th ed., Association of Official Analytical Chemists, Washington D.C.).

Metabolisable energy can be calculated on the basis of the NRC publication Nutrient requirements in swine, tenth revised edition 1988, subcommittee on swine nutrition, committee on animal nutrition, board of agriculture, national research council. National Academy Press, Washington, D.C., pp. 2-6, and the European Table of Energy Values for Poultry Feed-stuffs, Spelderholt centre for poultry research and extension, 7361 D A Beekbergen, The Netherlands. Grafisch bedrijf Ponsen & Iooijen by, Wageningen. ISBN 90-71463-12-5.

The dietary content of calcium, available phosphorus and amino acids in complete animal diets is calculated on the basis of feed tables such as Veevoedertabel 1997, gegevens over chemische samenstelling, verteerbaarheid en voederwaarde van voedermiddelen, Central Veevoederbureau, Runderweg 6, 8219 pk Lelystad. ISBN 90-72839-13-7.

In a particular embodiment, the animal feed composition of the invention contains at least one vegetable protein as defined above.

The animal feed composition of the invention may also contain animal protein, such as Meat and Bone Meal, Feather meal, and/or Fish Meal, typically in an amount of 0-25%. The animal feed composition of the invention may also comprise Dried Distillers Grains with Solubles (DDGS), typically in amounts of 0-30%.

In still further particular embodiments, the animal feed composition of the invention contains 0-80% maize; and/or 0-80% sorghum; and/or 0-70% wheat; and/or 0-70% Barley; and/or 0-30% oats; and/or 0-40% soybean meal; and/or 0-25% fish meal; and/or 0-25% meat and bone meal; and/or 0-20% whey.

The animal feed may comprise vegetable proteins. In particular embodiments, the protein content of the vegetable proteins is at least 10, 20, 30, 40, 50, 60, 70, 80, or 90% (w/w). Vegetable proteins may be derived from vegetable protein sources, such as legumes and cereals, for example, materials from plants of the families Fabaceae (Leguminosae), Cruciferaceae, Chenopodiaceae, and Poaceae, such as soy bean meal, lupin meal, rapeseed meal, and combinations thereof.

In a particular embodiment, the vegetable protein source is material from one or more plants of the family Fabaceae, e.g., soybean, lupine, pea, or bean. In another particular embodiment, the vegetable protein source is material from one or more plants of the family Chenopodiaceae, e.g. beet, sugar beet, spinach or quinoa. Other examples of vegetable protein sources are rapeseed, and cabbage. In another particular embodiment, soybean is a preferred vegetable protein source. Other examples of vegetable protein sources are cereals such as barley, wheat, rye, oat, maize (corn), rice, and sorghum.

Animal diets can e.g. be manufactured as mash feed (non-pelleted) or pelleted feed. Typically, the milled feedstuffs are mixed and sufficient amounts of essential vitamins and minerals are added according to the specifications for the species in question. Enzymes can be added as solid or liquid enzyme formulations. For example, for mash feed a solid or liquid enzyme formulation may be added before or during the ingredient mixing step. For pelleted feed the (liquid or solid) xylanase/enzyme preparation may also be added before or during the feed ingredient step. Typically a liquid enzyme preparation comprises the xylanase and/or arabinofuranosidase of the invention optionally with a polyol, such as glycerol, ethylene glycol or propylene glycol, and is added after the pelleting step, such as by spraying the liquid formulation onto the pellets. The enzyme may also be incorporated in a feed additive or premix.

Alternatively, the xylanase and/or arabinofuranosidase can be prepared by freezing a mixture of liquid enzyme solution with a bulking agent such as ground soybean meal, and then lyophilizing the mixture.

The final enzyme concentration in the diet is within the range of 0.01-200 mg enzyme protein per kg diet, preferably between 0.05-100 mg/kg, more preferably 0.1-50 mg/kg, even more preferably 0.2-20 mg enzyme protein per kg animal diet, for each enzyme.

It is at present contemplated that the xylanase is administered in one or more of the following amounts (dosage ranges): 0.01-200; 0.05-100; 0.1-50; 0.2-20; 0.1-1; 0.2-2; 0.5-5; or 1-10 wherein all these ranges are mg xylanase protein per kg feed (ppm). It is at present contemplated that the arabinofuranosidase is administered in one or more of the following amounts (dosage ranges): 0.01-200; 0.05-100; 0.1-50; 0.2-20; 0.1-1; 0.2-2; 0.5-5; or 1-10 wherein all these ranges are mg arabinofuranosidase protein per kg feed (ppm). It is further contemplated that the ratio of the GH10 or 11 xylanase to GH62 arabinofuranosidase is in the range of 100:1 to 1:100 xylanase: arabinofuranosidase such as the ranges 50:1 to 1:50, 50:1 to 1:10, 25:1 to 1:5, 10:1 to 1:2 or such as 10:1 to 1:50, 5:1 to 1:25, 2:1 to 1:10 xylanase: arabinofuranosidase.

For determining mg xylanase and/or mg arabinofuranosidase protein per kg feed, the xylanase and/or arabinofuranosidase is purified from the feed composition, and the specific activity of the purified xylanase and/or arabinofuranosidase is determined using a relevant assay (see under xylanase or arabinofuranosidase activity). The xylanase and/or arabinofuranosidase activity of the feed composition as such is also determined using the same assay, and on the basis of these two determinations, the dosage in mg xylanase and/or mg arabinofuranosidase protein per kg feed is calculated.

In a particular embodiment, the animal feed additive of the invention is intended for being included (or prescribed as having to be included) in animal diets or feed at levels of 0.01 to 10.0%; more particularly 0.05 to 5.0%; or 0.2 to 1.0% (% meaning g additive per 100 g feed). This is so in particular for premixes.

The same principles apply for determining mg xylanase or mg arabinofuranosidase protein in feed additives. Of course, if a sample is available of the xylanase or arabinofuranosidase used for preparing the feed additive or the feed, the specific activity is determined from this sample (no need to purify the xylanase or arabinofuranosidase from the feed composition or the additive).

Additional Enzymes

In another embodiment, the compositions described herein optionally include one or more enzymes. Enzymes can be classified on the basis of the handbook Enzyme Nomenclature from NC-IUBMB, 1992), see also the ENZYME site at the internet: http://www.expasy.ch/enzyme/. ENZYME is a repository of information relative to the nomenclature of enzymes. It is primarily based on the recommendations of the Nomenclature Committee of the International Union of Biochemistry and Molecular Biology (IUB-MB), Academic Press, Inc., 1992, and it describes each type of characterized enzyme for which an EC (Enzyme Commission) number has been provided (Bairoch A. The ENZYME database, 2000, Nucleic Acids Res 28:304-305). This IUB-MB Enzyme nomenclature is based on their substrate specificity and occasionally on their molecular mechanism; such a classification does not reflect the structural features of these enzymes.

Another classification of certain glycoside hydrolase enzymes, such as endoglucanase, xylanase, galactanase, mannanase, dextranase, lysozyme and galactosidase is described in Henrissat et al, "The carbohydrate-active enzymes database (CAZy) in 2013", Nucl. Acids Res. (1 Jan. 2014) 42 (D1): D490-D495; see also www.cazy.org.

Thus the composition of the invention may also comprise at least one other enzyme selected from the group comprising of phytase (EC 3.1.3.8 or 3.1.3.26); xylanase (EC 3.2.1.8); galactanase (EC 3.2.1.89); alpha-galactosidase (EC 3.2.1.22); protease (EC 3.4); phospholipase A1 (EC 3.1.1.32); phospholipase A2 (EC 3.1.1.4); lysophospholipase (EC 3.1.1.5); phospholipase C (3.1.4.3); phospholipase D (EC 3.1.4.4); amylase such as, for example, alpha-amylase (EC 3.2.1.1); lysozyme (EC 3.2.1.17); arabinofuranosidase (EC 3.2.1.55); beta-xylosidase (EC 3.2.1.37); acetyl xylan esterase (EC 3.1.1.72); feruloyl esterase (EC 3.1.1.73); cellulase (EC 3.2.1.4); cellobiohydrolases (EC 3.2.1.91); beta-glucosidase (EC 3.2.1.21); pullulanase (EC 3.2.1.41) and beta-glucanase (EC 3.2.1.4 or EC 3.2.1.6), or any mixture thereof.

In a particular embodiment, the composition of the invention comprises a phytase (EC 3.1.3.8 or 3.1.3.26). Examples of commercially available phytases include Bio-Feed™ Phytase (Novozymes), Ronozyme® P, Ronozyme® NP and Ronozyme® HiPhos (DSM Nutritional Products), Natuphos™ (BASF), Finase® and Quantum® Blue (AB Enzymes), OptiPhos® (Huvepharma) Phyzyme® XP (Verenium/DuPont) and Axtra® PHY (DuPont). Other preferred phytases include those described in e.g. WO 98/28408, WO 00/43503, and WO 03/066847.

In a particular embodiment, the composition of the invention comprises a xylanase (EC 3.2.1.8). Examples of commercially available xylanases include Ronozyme® WX and Ronozyme® G2 (DSM Nutritional Products), Econase® XT and Barley (AB Vista), Xylathin® (Verenium), Hostazym® X (Huvepharma) and Axtra® XB (Xylanase/beta-glucanase, DuPont)

In a particular embodiment, the composition of the invention comprises a protease (EC 3.4). Examples of commercially available proteases include Ronozyme® ProAct (DSM Nutritional Products).

Microbes

In an embodiment, the animal feed composition further comprises one or more additional microbes. In a particular embodiment, the animal feed composition further comprises a *bacterium* from one or more of the following genera: *Lactobacillus, Lactococcus, Streptococcus, Bacillus, Pediococcus, Enterococcus, Leuconostoc, Carnobacterium, Propionibacterium, Bifidobacterium, Clostridium* and *Megasphaera* or any combination thereof.

In a preferred embodiment, animal feed composition further comprises a *bacterium* from one or more of the following strains: *Bacillus subtilis, Bacillus licheniformis, Bacillus amyloliquefaciens, Bacillus cereus, Bacillus pumilus, Bacillus polymyxa, Bacillus megaterium, Bacillus coagulans, Bacillus circulans, Bifidobacterium bifidum, Bifidobacterium animalis, Bifidobacterium sp., Carnobacterium sp., Clostridium butyricum, Clostridium sp., Enterococcus faecium, Enterococcus sp., Lactobacillus sp., Lactobacillus acidophilus, Lactobacillus farciminus, Lactobacillus rhamnosus, Lactobacillus reuteri, Lactobacillus salivarius, Lactococcus lactis, Lactococcus sp., Leuconostoc sp., Megasphaera elsdenii, Megasphaera sp., Pediococsus acidilactici, Pediococcus sp., Propionibacterium thoenii, Propionibacterium sp.* and *Streptococcus sp.*

In a more preferred embodiment, animal feed composition further comprises a *bacterium* from one or more of the following strains of *Bacillus subtilis:* 3A-P4 (PTA-6506); 15A-P4 (PTA-6507); 22C-P1 (PTA-6508); 2084 (NRRL B-500130); LSSA01 (NRRL-B-50104); BS27 (NRRL B-501 05); BS 18 (NRRL B-50633); and BS 278 (NRRL B-50634).

The bacterial count of each of the bacterial strains in the animal feed composition is between $1\times10^4$ and $1\times10^{14}$ CFU/kg of dry matter, preferably between $1\times10^6$ and $1\times10^{12}$ CFU/kg of dry matter, and more preferably between $1\times10^7$ and $1\times10^{11}$ CFU/kg of dry matter. In a more preferred embodiment the bacterial count of each of the bacterial strains in the animal feed composition is between $1\times10^8$ and $1\times10^{10}$ CFU/kg of dry matter.

The bacterial count of each of the bacterial strains in the animal feed composition is between $1\times10^5$ and $1\times10^{15}$ CFU/animal/day, preferably between $1\times10^7$ and $1\times10^{13}$ CFU/animal/day, and more preferably between $1\times10^8$ and $1\times10^{12}$ CFU/animal/day. In a more preferred embodiment the bacterial count of each of the bacterial strains in the animal feed composition is between $1\times10^9$ and $1\times10^{11}$ CFU/animal/day.

In another embodiment, the one or more bacterial strains are present in the form of a stable spore.

Premix

In an embodiment, the animal feed may include a premix, comprising e.g. vitamins, minerals, enzymes, preservatives, antibiotics, other feed ingredients or any combination thereof which are mixed into the animal feed.

Vitamins and Minerals

In another embodiment, the animal feed may include one or more vitamins, such as one or more fat-soluble vitamins and/or one or more water-soluble vitamins. In another embodiment, the animal feed may optionally include one or more minerals, such as one or more trace minerals and/or one or more macro minerals.

Usually fat- and water-soluble vitamins, as well as trace minerals form part of a so-called premix intended for addition to the feed, whereas macro minerals are usually separately added to the feed.

Non-limiting examples of fat-soluble vitamins include vitamin A, vitamin D3, vitamin E, and vitamin K, e.g., vitamin K3.

Non-limiting examples of water-soluble vitamins include vitamin B12, biotin and choline, vitamin B1, vitamin B2, vitamin B6, niacin, folic acid and panthothenate, e.g., Ca-D-panthothenate.

Non-limiting examples of trace minerals include boron, cobalt, chloride, chromium, copper, fluoride, iodine, iron, manganese, molybdenum, selenium and zinc.

Non-limiting examples of macro minerals include calcium, magnesium, potassium and sodium.

The nutritional requirements of these components (exemplified with poultry and piglets/pigs) are listed in Table A of WO 01/58275. Nutritional requirement means that these components should be provided in the diet in the concentrations indicated.

In the alternative, the animal feed additive of the invention comprises at least one of the individual components specified in Table A of WO 01/58275. At least one means either of, one or more of, one, or two, or three, or four and so forth up to all thirteen, or up to all fifteen individual components. More specifically, this at least one individual component is included in the additive of the invention in such an amount as to provide an in-feed-concentration within the range indicated in column four, or column five, or column six of Table A.

In a still further embodiment, the animal feed additive of the invention comprises at least one of the below vitamins, preferably to provide an in-feed-concentration within the ranges specified in the below Table 1 (for piglet diets, and broiler diets, respectively).

TABLE 1

Typical vitamin recommendations

| Vitamin | Piglet diet | Broiler diet |
| --- | --- | --- |
| Vitamin A | 10,000-15,000 IU/kg feed | 8-12,500 IU/kg feed |
| Vitamin D3 | 1800-2000 IU/kg feed | 3000-5000 IU/kg feed |
| Vitamin E | 60-100 mg/kg feed | 150-240 mg/kg feed |
| Vitamin K3 | 2-4 mg/kg feed | 2-4 mg/kg feed |
| Vitamin B1 | 2-4 mg/kg feed | 2-3 mg/kg feed |
| Vitamin B2 | 6-10 mg/kg feed | 7-9 mg/kg feed |
| Vitamin B6 | 4-8 mg/kg feed | 3-6 mg/kg feed |
| Vitamin B12 | 0.03-0.05 mg/kg feed | 0.015-0.04 mg/kg feed |
| Niacin (Vitamin B3) | 30-50 mg/kg feed | 50-80 mg/kg feed |
| Pantothenic acid | 20-40 mg/kg feed | 10-18 mg/kg feed |
| Folic acid | 1-2 mg/kg feed | 1-2 mg/kg feed |
| Biotin | 0.15-0.4 mg/kg feed | 0.15-0.3 mg/kg feed |
| Choline chloride | 200-400 mg/kg feed | 300-600 mg/kg feed |

Amino Acids

The composition of the invention may further comprise one or more amino acids. Examples of amino acids which are used in animal feed are lysine, alanine, beta-alanine, threonine, methionine and tryptophan.

Other Feed Ingredients

The composition of the invention may further comprise colouring agents, stabilisers, growth improving additives and aroma compounds/flavourings, polyunsaturated fatty acids (PUFAs); reactive oxygen generating species, antimicrobial peptides and anti-fungal polypeptides.

Examples of colouring agents are carotenoids such as beta-carotene, astaxanthin, and lutein.

Examples of aroma compounds/flavourings are creosol, anethol, deca-, undeca- and/or dodeca-lactones, ionones, irone, gingerol, piperidine, propylidene phatalide, butylidene phatalide, capsaicin and tannin.

Examples of antimicrobial peptides (AMP's) are CAP18, Leucocin A, Tritrpticin, Protegrin-1, Thanatin, Defensin, Lactoferrin, Lactoferricin, and Ovispirin such as Novispirin (Robert Lehrer, 2000), Plectasins, and Statins, including the compounds and polypeptides disclosed in WO 03/044049 and WO 03/048148, as well as variants or fragments of the above that retain antimicrobial activity.

Examples of antifungal polypeptides (AFP's) are the *Aspergillus giganteus*, and *Aspergillus niger* peptides, as well as variants and fragments thereof which retain antifungal activity, as disclosed in WO 94/01459 and WO 02/090384.

Examples of polyunsaturated fatty acids are C18, C20 and C22 polyunsaturated fatty acids, such as arachidonic acid, docosohexaenoic acid, eicosapentaenoic acid and gamma-linoleic acid.

Examples of reactive oxygen generating species are chemicals such as perborate, persulphate, or percarbonate; and enzymes such as an oxidase, an oxygenase or a syntethase.

The composition of the invention may further comprise at least one amino acid. Examples of amino acids which are used in animal feed are lysine, alanine, beta-alanine, threonine, methionine and tryptophan.

Uses

The present invention is also directed to methods for using the polypeptides having xylanase and/or arabinofuranosidase activity, or compositions thereof, for e.g. animal feed. The present invention is also directed to processes for using the polypeptides having xylanase and/or arabinofuranosidase activity, or compositions thereof, such as e.g. those described below.

Use in Animal Feed

The present invention is also directed to methods for using the xylanases and/or arabinofuranosidase of the invention in animal feed.

The term animal includes all animals. Examples of animals are non-ruminants, and ruminants. Ruminant animals include, for example, animals such as sheep, goats, and cattle, e.g. beef cattle, cows, and young calves. In a particular embodiment, the animal is a non-ruminant animal. Non-ruminant animals include mono-gastric animals, e.g. pigs or swine (including, but not limited to, piglets, growing pigs, and sows); poultry such as turkeys, ducks and chicken (including but not limited to broiler chicks, layers); horses (including but not limited to hotbloods, coldbloods and warm bloods), young calves; and fish (including but not limited to salmon, trout, tilapia, catfish and carps; and crustaceans (including but not limited to shrimps and prawns).

In the use according to the invention the xylanases and/or arabinofuranosidases can be fed to the animal before, after, or simultaneously with the diet. The latter is preferred.

In a particular embodiment, the form in which the xylanase and/or arabinofuranosidase is added to the feed, or animal feed additive, is well-defined. Well-defined means that the xylanase and/or arabinofuranosidase preparation is at least 50% pure as determined by Size-exclusion chromatography (see Example 12 of WO 01/58275). In other particular embodiments the xylanase and/or arabinofuranosidase preparation is at least 60, 70, 80, 85, 88, 90, 92, 94, or at least 95% pure as determined by this method.

A well-defined xylanase and/or arabinofuranosidase preparation is advantageous. For instance, it is much easier to dose correctly to the feed a xylanase and/or arabinofuranosidase that is essentially free from interfering or contaminating other xylanases and/or arabinofuranosidases. The term dose correctly refers in particular to the objective of obtaining consistent and constant results, and the capability of optimizing dosage based upon the desired effect.

For the use in animal feed, however, the xylanase and/or arabinofuranosidase need not be that pure; it may e.g. include other enzymes, in which case it could be termed a xylanase and/or arabinofuranosidase preparation.

The xylanase and/or arabinofuranosidase preparation can be (a) added directly to the feed, or (b) it can be used in the production of one or more intermediate compositions such as feed additives or premixes that is subsequently added to the feed (or used in a treatment process). The degree of purity described above refers to the purity of the original xylanase and/or arabinofuranosidase preparation, whether used according to (a) or (b) above.

Preferred Embodiments of the Invention

Preferred embodiments of the invention are described in the set of items below.

1. A composition comprising one or more GH10 or GH11 polypeptides having xylanase activity and one or more GH62 polypeptides having arabinofuranosidase activity, wherein:
   (a) the GH62 polypeptide comprises the motif [H/Y][L/M]F[F/S][A/C/H/S/T/V][A/D/G/N/R]D[D/E/N]G (SEQ ID NO: 1);
   (b) the GH10 or GH11 polypeptide and the GH62 polypeptide together solubilise at least 2.0% xylose from defatted destarched maize (DFDSM); and
   (c) the GH10 or GH11 polypeptide and the GH62 polypeptide together solubilise at least 2 times more xylose from DFDSM than the GH10 or GH11 polypeptide can when the GH62 polypeptide is not present;
   wherein (b) and (c) are performed under the reaction conditions:
   i) 25 mg GH10 or GH11 polypeptide per kg DFDSM,
   ii) 12.5 mg GH62 polypeptide per kg DFDSM, and
   iii) incubation at 40° C., pH 5 for 4 hours.

2. The composition of item 1, wherein the GH62 polypeptide comprises one or more motifs selected from the list consisting of [H/Y]LF[F/S][A/S/V][A/D/G]DNG (SEQ ID NO: 2), YLFF[A/V][A/G]DNG (SEQ ID NO: 3), YLFFAGDNG (SEQ ID NO: 4), [H/Y]LFSSDDNG (SEQ ID NO: 5), and YLFSSDDNG (SEQ ID NO: 6).

3. The composition of any of items 1 to 2, wherein the GH62 polypeptide having arabinofuranosidase activity is selected from the group consisting of:
   (a) a polypeptide having at least 80% sequence identity to the polypeptide of SEQ ID NO: 9;
   (b) a polypeptide having at least 80% sequence identity to the polypeptide of SEQ ID NO: 12;
   (c) a polypeptide having at least 80% sequence identity to the polypeptide of SEQ ID NO: 15;
   (d) a polypeptide having at least 80% sequence identity to the polypeptide of SEQ ID NO: 18;
   (e) a polypeptide having at least 80% sequence identity to the polypeptide of SEQ ID NO: 21;
   (f) a polypeptide having at least 80% sequence identity to the polypeptide of SEQ ID NO: 24;
   (g) a polypeptide having at least 80% sequence identity to the polypeptide of SEQ ID NO: 27;
   (h) a polypeptide having at least 80% sequence identity to the polypeptide of SEQ ID NO: 30;
   (i) a polypeptide having at least 80% sequence identity to the polypeptide of SEQ ID NO: 36;

(j) a polypeptide having at least 80% sequence identity to the polypeptide of SEQ ID NO: 42;
(k) a polypeptide having at least 80% sequence identity to the polypeptide of SEQ ID NO: 48;
(l) a polypeptide having at least 80% sequence identity to the polypeptide of SEQ ID NO: 54;
(m) a polypeptide having at least 80% sequence identity to the polypeptide of SEQ ID NO: 60;
(n) a polypeptide having at least 80% sequence identity to the polypeptide of SEQ ID NO: 66;
(o) a polypeptide having at least 80% sequence identity to the polypeptide of SEQ ID NO: 105;
(p) a polypeptide having at least 80% sequence identity to the polypeptide of SEQ ID NO: 108;
(q) a polypeptide having at least 80% sequence identity to the polypeptide of SEQ ID NO: 114;
(r) a polypeptide having at least 80% sequence identity to the polypeptide of SEQ ID NO: 120;
(s) a polypeptide having at least 80% sequence identity to the polypeptide of SEQ ID NO: 123;
(t) a polypeptide having at least 80% sequence identity to the polypeptide of SEQ ID NO: 126;
(u) a polypeptide having at least 80% sequence identity to the polypeptide of SEQ ID NO: 132;
(v) a polypeptide having at least 80% sequence identity to the polypeptide of SEQ ID NO: 138;
(w) a polypeptide having at least 80% sequence identity to the polypeptide of SEQ ID NO: 141;
(x) a polypeptide having at least 80% sequence identity to the polypeptide of SEQ ID NO: 147;
(y) a polypeptide having at least 80% sequence identity to the polypeptide of SEQ ID NO: 150;
(z) a polypeptide having at least 80% sequence identity to the polypeptide of SEQ ID NO: 156;
(aa) a polypeptide having at least 80% sequence identity to the polypeptide of SEQ ID NO: 159;
(ab) a polypeptide having at least 80% sequence identity to the polypeptide of SEQ ID NO: 162;
(ac) a polypeptide having at least 80% sequence identity to the polypeptide of SEQ ID NO: 165;
(ad) a polypeptide having at least 80% sequence identity to the polypeptide of SEQ ID NO: 168;
(ae) a polypeptide having at least 80% sequence identity to the polypeptide of SEQ ID NO: 171;
(af) a polypeptide having at least 80% sequence identity to the polypeptide of SEQ ID NO: 174;
(ag) a variant of the polypeptide selected from the group consisting of SEQ ID NO: 9, SEQ ID NO: 12, SEQ ID NO: 15, SEQ ID NO: 18, SEQ ID NO: 21, SEQ ID NO: 24, SEQ ID NO: 27, SEQ ID NO: 30, SEQ ID NO: 36, SEQ ID NO: 42, SEQ ID NO: 48, SEQ ID NO: 54, SEQ ID NO: 60, SEQ ID NO: 66 SEQ ID NO: 105, SEQ ID NO: 108, SEQ ID NO: 114, SEQ ID NO: 120, SEQ ID NO: 123, SEQ ID NO: 126, SEQ ID NO: 132, SEQ ID NO: 138, SEQ ID NO: 141, SEQ ID NO: 147, SEQ ID NO: 150, SEQ ID NO: 156, SEQ ID NO: 159, SEQ ID NO: 162, SEQ ID NO: 165, SEQ ID NO: 168, SEQ ID NO: 171 and SEQ ID NO: 174 wherein the variant has arabinofuranosidase activity and comprises one or more amino acid substitutions, and/or one or more amino acid deletions, and/or one or more amino acid insertions or any combination thereof in 1, 2, 3, 4, 5, 6, 7, 8, 9 or 10 positions;
(ah) a polypeptide comprising the polypeptide of (a), (b), (c), (d), (e), (f), (g), (h), (i), (j), (k), (l), (m), (n), (o), (p), (q), (r), (s), (t), (u), (v), (w), (x), (y), (z), (aa), (ab), (ac), (ad), (ae), (af) or (ag) and a N-terminal and/or C-terminal His-tag and/or HQ-tag; and
(ai) a fragment of the polypeptide of (a), (b), (c), (d), (e), (f), (g), (h), (i), (j), (k), (l), (m), (n), (o), (p), (q), (r), (s), (t), (u), (v), (w), (x), (y), (z), (aa), (ab), (ac), (ad), (ae), (af), (ag) or (ah) having arabinofuranosidase activity and having at least 90% of the length of the mature polypeptide.

4. The composition according to item 3, wherein the GH62 polypeptide having arabinofuranosidase activity comprises or consists of amino acids 1 to 302 of SEQ ID NO: 9, amino acids 1 to 303 of SEQ ID NO: 12, amino acids 1 to 382 of SEQ ID NO: 15, amino acids 1 to 378 of SEQ ID NO: 18, amino acids 1 to 311 of SEQ ID NO: 21, amino acids 1 to 302 of SEQ ID NO: 24, amino acids 1 to 309 of SEQ ID NO: 27, amino acids 1 to 438 of SEQ ID NO: 30, amino acids 1 to 446 of SEQ ID NO: 33, amino acids 1 to 438 of SEQ ID NO: 36, amino acids 1 to 446 of SEQ ID NO: 39, amino acids 1 to 318 of SEQ ID NO: 42, amino acids 1 to 326 of SEQ ID NO: 45, amino acids 1 to 302 of SEQ ID NO: 48, amino acids 1 to 311 of SEQ ID NO: 51, amino acids 1 to 364 of SEQ ID NO: 54, amino acids 1 to 373 of SEQ ID NO: 57, amino acids 1 to 436 of SEQ ID NO: 60, amino acids 1 to 444 of SEQ ID NO: 63, amino acids 1 to 302 of SEQ ID NO: 66, amino acids 1 to 311 of SEQ ID NO: 69, amino acids 1 to 302 of SEQ ID NO: 105, amino acids 1 to 464 of SEQ ID NO: 108, amino acids 1 to 472 of SEQ ID NO: 111, amino acids 1 to 364 of SEQ ID NO: 114, amino acids 1 to 372 of SEQ ID NO: 117, amino acids 1 to 357 of SEQ ID NO: 120, amino acids 1 to 302 of SEQ ID NO: 123, amino acids 1 to 453 of SEQ ID NO: 126, amino acids 1 to 461 of SEQ ID NO: 129, amino acids 1 to 377 of SEQ ID NO: 132, amino acids 1 to 385 of SEQ ID NO: 135, amino acids 1 to 309 of SEQ ID NO: 138, amino acids 1 to 304 of SEQ ID NO: 141, amino acids 1 to 312 of SEQ ID NO: 144, amino acids 1 to 302 of SEQ ID NO: 147, amino acids 1 to 302 of SEQ ID NO: 150, amino acids 1 to 310 of SEQ ID NO: 153, amino acids 1 to 316 of SEQ ID NO: 156, amino acids 1 to 316 of SEQ ID NO: 159, amino acids 1 to 303 of SEQ ID NO: 162, amino acids 1 to 361 of SEQ ID NO: 165, amino acids 1 to 373 of SEQ ID NO: 168, amino acids 1 to 302 of SEQ ID NO: 171 or amino acids 1 to 364 of SEQ ID NO: 174.

5. The composition of any of items 1 to 4, wherein the GH10 or GH11 polypeptide having xylanase activity is selected from the group consisting of:
(a) a polypeptide having at least 80% sequence identity to the polypeptide of SEQ ID NO: 70;
(b) a polypeptide having at least 80% sequence identity to the polypeptide of SEQ ID NO: 71;
(c) a polypeptide having at least 80% sequence identity to the polypeptide of SEQ ID NO: 72;
(d) a polypeptide having at least 80% sequence identity to the polypeptide of SEQ ID NO: 73;
(e) a polypeptide having at least 80% sequence identity to the polypeptide of SEQ ID NO: 74;
(f) a polypeptide having at least 80% sequence identity to the polypeptide of SEQ ID NO: 75;
(g) a polypeptide having at least 80% sequence identity to the polypeptide of SEQ ID NO: 78;
(h) a polypeptide having at least 80% sequence identity to the polypeptide of SEQ ID NO: 81;
(i) a polypeptide having at least 80% sequence identity to the polypeptide of SEQ ID NO: 84;
(j) a polypeptide having at least 80% sequence identity to the polypeptide of SEQ ID NO: 88;

(k) a polypeptide having at least 80% sequence identity to the polypeptide of SEQ ID NO: 89;

(l) a polypeptide having at least 80% sequence identity to the polypeptide of SEQ ID NO: 95;

(m) a polypeptide having at least 80% sequence identity to the polypeptide of SEQ ID NO: 96;

(n) a polypeptide having at least 80% sequence identity to the polypeptide of SEQ ID NO: 99;

(o) a polypeptide having at least 80% sequence identity to the polypeptide of SEQ ID NO: 102;

(p) a polypeptide having at least 80% sequence identity to the polypeptide of SEQ ID NO: 177;

(q) a variant of the polypeptide selected from the group consisting of SEQ ID NO: 70, SEQ ID NO: 71, SEQ ID NO: 72, SEQ ID NO: 73, SEQ ID NO: 74, SEQ ID NO: 75, SEQ ID NO: 78, SEQ ID NO: 81, SEQ ID NO: 84, SEQ ID NO: 88, SEQ ID NO: 89, SEQ ID NO: 95, SEQ ID NO: 96, SEQ ID NO: 99, SEQ ID NO: 102 and SEQ ID NO: 177 wherein the variant has xylanase activity and comprises one or more amino acid substitutions, and/or one or more amino acid deletions, and/or one or more amino acid insertions or any combination thereof in 1, 2, 3, 4, 5, 6, 7, 8, 9 or 10 positions;

(r) a polypeptide comprising the polypeptide of (a), (b), (c), (d), (e), (f), (g), (h), (i), (j), (k), (l), (m), (n), (o), (p) or (q) and a N-terminal and/or C-terminal His-tag and/or HQ-tag; and (s) a fragment of the polypeptide of (a), (b), (c), (d), (e), (f), (g), (h), (i), (j), (k), (l), (m), (n), (o), (p), (q) or (r) having xylanase activity and having at least 90% of the length of the mature polypeptide.

6. The composition according to item 5, wherein the GH10 or GH11 polypeptide comprises or consists of amino acids 1 to 384 of SEQ ID NO: 70, amino acids 1 to 288 of SEQ ID NO: 71, amino acids 1 to 308 of SEQ ID NO: 72, amino acids 1 to 195 of SEQ ID NO: 73, amino acids 1 to 203 of SEQ ID NO: 74, amino acids 1 to 182 of SEQ ID NO: 75, amino acids 1 to 183 of SEQ ID NO: 78, amino acids 1 to 181 of SEQ ID NO: 81, amino acids 1 to 299 of SEQ ID NO: 84, amino acids 1 to 307 of SEQ ID NO: 87, amino acids 1 to 188 of SEQ ID NO: 88, amino acids 1 to 189 of SEQ ID NO: 89, amino acids 1 to 328 of SEQ ID NO: 95, amino acids 1 to 208 of SEQ ID NO:96, amino acids 1 to 203 of SEQ ID NO:99, amino acids 1 to 337 of SEQ ID NO:102 or amino acids 1 to 323 of SEQ ID NO: 177.

7. The composition of any of items 1 to 6, wherein the GH10 or GH11 polypeptide and the GH62 polypeptide together solubilise at least 0.4% xylose from DFDSM and the GH10 or GH11 polypeptide and the GH62 polypeptide together solubilise at least 2.5 times more xylose from DFDSM than the GH10 or GH11 polypeptide can when the GH62 polypeptide is not present.

8. The composition of any of items 1 to 6, wherein the GH10 or GH11 polypeptide and the GH62 polypeptide together solubilise at least 0.4% xylose from DFDSM and the GH10 or GH11 polypeptide and the GH62 polypeptide together solubilise at least 3 times more xylose from DFDSM than the GH10 or GH11 polypeptide can when the GH62 polypeptide is not present.

9. The composition of any of items 1 to 6, wherein the GH10 or GH11 polypeptide and the GH62 polypeptide together solubilise at least 0.4% xylose from DFDSM and the GH10 or GH11 polypeptide and the GH62 polypeptide together solubilise at least 3.5 times more xylose from DFDSM than the GH10 or GH11 polypeptide can when the GH62 polypeptide is not present.

10. The composition of any of items 1 to 6, wherein the GH10 or GH11 polypeptide and the GH62 polypeptide together solubilise at least 0.4% xylose from DFDSM and the GH10 or GH11 polypeptide and the GH62 polypeptide together solubilise at least 4 times more xylose from DFDSM than the GH10 or GH11 polypeptide can when the GH62 polypeptide is not present.

11. The composition of any of items 1 to 6, wherein the GH10 or GH11 polypeptide and the GH62 polypeptide together solubilise at least 0.6% xylose from DFDSM and the GH10 or GH11 polypeptide and the GH62 polypeptide together solubilise at least 2 times more xylose from DFDSM than the GH10 or GH11 polypeptide can when the GH62 polypeptide is not present.

12. The composition of any of items 1 to 6, wherein the GH10 or GH11 polypeptide and the GH62 polypeptide together solubilise at least 0.6% xylose from DFDSM and the GH10 or GH11 polypeptide and the GH62 polypeptide together solubilise at least 2.5 times more xylose from DFDSM than the GH10 or GH11 polypeptide can when the GH62 polypeptide is not present.

13. The composition of any of items 1 to 6, wherein the GH10 or GH11 polypeptide and the GH62 polypeptide together solubilise at least 0.6% xylose from DFDSM and the GH10 or GH11 polypeptide and the GH62 polypeptide together solubilise at least 3 times more xylose from DFDSM than the GH10 or GH11 polypeptide can when the GH62 polypeptide is not present.

14. The composition of any of items 1 to 6, wherein the GH10 or GH11 polypeptide and the GH62 polypeptide together solubilise at least 0.6% xylose from DFDSM and the GH10 or GH11 polypeptide and the GH62 polypeptide together solubilise at least 3.5 times more xylose from DFDSM than the GH10 or GH11 polypeptide can when the GH62 polypeptide is not present.

15. The composition of any of items 1 to 6, wherein the GH10 or GH11 polypeptide and the GH62 polypeptide together solubilise at least 0.8% xylose from DFDSM and the GH10 or GH11 polypeptide and the GH62 polypeptide together solubilise at least 2 times more xylose from DFDSM than the GH10 or GH11 polypeptide can when the GH62 polypeptide is not present.

16. The composition of any of items 1 to 6, wherein the GH10 or GH11 polypeptide and the GH62 polypeptide together solubilise at least 0.8% xylose from DFDSM and the GH10 or GH11 polypeptide and the GH62 polypeptide together solubilise at least 2.5 times more xylose from DFDSM than the GH10 or GH11 polypeptide can when the GH62 polypeptide is not present.

17. The composition of any of items 1 to 6, wherein the GH10 or GH11 polypeptide and the GH62 polypeptide together solubilise at least 0.8% xylose from DFDSM and the GH10 or GH11 polypeptide and the GH62 polypeptide together solubilise at least 3 times more xylose from DFDSM than the GH10 or GH11 polypeptide can when the GH62 polypeptide is not present.

18. The composition of any of items 1 to 6, wherein the GH10 or GH11 polypeptide and the GH62 polypeptide together solubilise at least 0.8% xylose from DFDSM and the GH10 or GH11 polypeptide and the GH62 polypeptide together solubilise at least 3.5 times more xylose from DFDSM than the GH10 or GH11 polypeptide can when the GH62 polypeptide is not present.

19. The composition of any of items 1 to 6, wherein the GH10 or GH11 polypeptide and the GH62 polypeptide together solubilise at least 1.0% xylose from DFDSM and the GH10 or GH11 polypeptide and the GH62 polypeptide together solubilise at least 2 times more xylose from DFDSM than the GH10 or GH11 polypeptide can when the GH62 polypeptide is not present.
20. The composition of any of items 1 to 6, wherein the GH10 or GH11 polypeptide and the GH62 polypeptide together solubilise at least 1.0% xylose from DFDSM and the GH10 or GH11 polypeptide and the GH62 polypeptide together solubilise at least 2.5 times more xylose from DFDSM than the GH10 or GH11 polypeptide can when the GH62 polypeptide is not present.
21. The composition of any of items 1 to 6, wherein the GH10 or GH11 polypeptide and the GH62 polypeptide together solubilise at least 1.0% xylose from DFDSM and the GH10 or GH11 polypeptide and the GH62 polypeptide together solubilise at least 3 times more xylose from DFDSM than the GH10 or GH11 polypeptide can when the GH62 polypeptide is not present.
22. The composition of any of items 1 to 6, wherein the GH10 or GH11 polypeptide and the GH62 polypeptide together solubilise at least 1.0% xylose from DFDSM and the GH10 or GH11 polypeptide and the GH62 polypeptide together solubilise at least 3.5 times more xylose from DFDSM than the GH10 or GH11 polypeptide can when the GH62 polypeptide is not present.
23. An isolated polypeptide having arabinofuranosidase activity, selected from the group consisting of:
  (a) a polypeptide having at least 85% sequence identity to the polypeptide of SEQ ID NO: 12;
  (b) a polypeptide having at least 97.6% sequence identity to the polypeptide of SEQ ID NO: 24;
  (c) a polypeptide having at least 80% sequence identity to the polypeptide of SEQ ID NO: 27;
  (d) a polypeptide having at least 90% sequence identity to the polypeptide of SEQ ID NO: 30;
  (e) a polypeptide having at least 92% sequence identity to the polypeptide of SEQ ID NO: 36;
  (f) a polypeptide having at least 86% sequence identity to the polypeptide of SEQ ID NO:48;
  (g) a polypeptide having at least 80% sequence identity to the polypeptide of SEQ ID NO:54;
  (h) a polypeptide having at least 81% sequence identity to the polypeptide of SEQ ID NO:60;
  (i) a polypeptide having at least 84% sequence identity to the polypeptide of SEQ ID NO:66;
  (j) a polypeptide having at least 87% sequence identity to the polypeptide of SEQ ID NO:105;
  (k) a polypeptide having at least 85% sequence identity to the polypeptide of SEQ ID NO:108;
  (l) a polypeptide having at least 80% sequence identity to the polypeptide of SEQ ID NO:114;
  (m) a polypeptide having at least 80% sequence identity to the polypeptide of SEQ ID NO:120;
  (n) a polypeptide having at least 89% sequence identity to the polypeptide of SEQ ID NO:123;
  (o) a polypeptide having at least 80% sequence identity to the polypeptide of SEQ ID NO:126;
  (p) a polypeptide having at least 85% sequence identity to the polypeptide of SEQ ID NO:138;
  (q) a polypeptide having at least 89% sequence identity to the polypeptide of SEQ ID NO:141;
  (r) a polypeptide having at least 86% sequence identity to the polypeptide of SEQ ID NO:147;
  (s) a polypeptide having at least 96.4% sequence identity to the polypeptide of SEQ ID NO:156;
  (t) a polypeptide having at least 80% sequence identity to the polypeptide of SEQ ID NO:162;
  (u) a polypeptide having at least 80% sequence identity to the polypeptide of SEQ ID NO:165;
  (v) a polypeptide having at least 80% sequence identity to the polypeptide of SEQ ID NO:168;
  (w) a polypeptide having at least 80% sequence identity to the polypeptide of SEQ ID NO:171;
  (x) a polypeptide having at least 82% sequence identity to the polypeptide of SEQ ID NO: 174;
  (y) a polypeptide encoded by a polynucleotide that hybridizes under high stringency conditions, or very high stringency conditions with
    (i) the mature polypeptide coding sequence of SEQ ID NO: 10,
    (ii) the mature polypeptide coding sequence of SEQ ID NO: 22,
    (iii) the mature polypeptide coding sequence of SEQ ID NO: 25,
    (iv) the mature polypeptide coding sequence of SEQ ID NO: 28,
    (v) the mature polypeptide coding sequence of SEQ ID NO: 34,
    (vi) the mature polypeptide coding sequence of SEQ ID NO: 46,
    (vii) the mature polypeptide coding sequence of SEQ ID NO: 52,
    (viii) the mature polypeptide coding sequence of SEQ ID NO: 58,
    (ix) the mature polypeptide coding sequence of SEQ ID NO: 64,
    (x) the mature polypeptide coding sequence of SEQ ID NO: 103,
    (xi) the mature polypeptide coding sequence of SEQ ID NO: 106,
    (xii) the mature polypeptide coding sequence of SEQ ID NO: 112,
    (xiii) the mature polypeptide coding sequence of SEQ ID NO: 118,
    (xiv) the mature polypeptide coding sequence of SEQ ID NO: 121,
    (xv) the mature polypeptide coding sequence of SEQ ID NO: 124,
    (xvi) the mature polypeptide coding sequence of SEQ ID NO: 136,
    (xvii) the mature polypeptide coding sequence of SEQ ID NO: 139,
    (xviii) the mature polypeptide coding sequence of SEQ ID NO: 145,
    (xix) the mature polypeptide coding sequence of SEQ ID NO: 154,
    (xx) the mature polypeptide coding sequence of SEQ ID NO: 160,
    (xxi) the mature polypeptide coding sequence of SEQ ID NO: 163,
    (xxii) the mature polypeptide coding sequence of SEQ ID NO: 166,
    (xxiii) the mature polypeptide coding sequence of SEQ ID NO: 169,
    (xxiv) the mature polypeptide coding sequence of SEQ ID NO: 172,
    (xxv) the full-length complementary strand of (i), (ii), (iii), (iv), (v), (vi), (vii), (viii), (ix), (x), (xi), (xii), (xiii), (xiv), (xv), (xvi), (xvii), (xviii), (xix), (xx), (xxi), (xxii), (xxiii) or (xxiv);

(z) a polypeptide encoded by a polynucleotide having at least 85% sequence identity to the mature polypeptide coding sequence of SEQ ID NO: 10;
(aa) a polypeptide encoded by a polynucleotide having at least 97.6% sequence identity to the mature polypeptide coding sequence of SEQ ID NO: 22;
(ab) a polypeptide encoded by a polynucleotide having at least 80% sequence identity to the mature polypeptide coding sequence of SEQ ID NO: 25;
(ac) a polypeptide encoded by a polynucleotide having at least 90% sequence identity to the mature polypeptide coding sequence of SEQ ID NO: 28;
(ad) a polypeptide encoded by a polynucleotide having at least 92% sequence identity to the mature polypeptide coding sequence of SEQ ID NO: 34;
(ae) a polypeptide encoded by a polynucleotide having at least 86% sequence identity to the mature polypeptide coding sequence of SEQ ID NO: 46;
(af) a polypeptide encoded by a polynucleotide having at least 80% sequence identity to the mature polypeptide coding sequence of SEQ ID NO: 52;
(ag) a polypeptide encoded by a polynucleotide having at least 81% sequence identity to the mature polypeptide coding sequence of SEQ ID NO: 58;
(ah) a polypeptide encoded by a polynucleotide having at least 84% sequence identity to the mature polypeptide coding sequence of SEQ ID NO: 64;
(ai) a polypeptide encoded by a polynucleotide having at least 87% sequence identity to the mature polypeptide coding sequence of SEQ ID NO: 103;
(aj) a polypeptide encoded by a polynucleotide having at least 85% sequence identity to the mature polypeptide coding sequence of SEQ ID NO: 106;
(ak) a polypeptide encoded by a polynucleotide having at least 80% sequence identity to the mature polypeptide coding sequence of SEQ ID NO: 111;
(al) a polypeptide encoded by a polynucleotide having at least 80% sequence identity to the mature polypeptide coding sequence of SEQ ID NO: 118;
(am) a polypeptide encoded by a polynucleotide having at least 89% sequence identity to the mature polypeptide coding sequence of SEQ ID NO: 121;
(an) a polypeptide encoded by a polynucleotide having at least 80% sequence identity to the mature polypeptide coding sequence of SEQ ID NO: 124;
(ao) a polypeptide encoded by a polynucleotide having at least 85% sequence identity to the mature polypeptide coding sequence of SEQ ID NO: 136;
(ap) a polypeptide encoded by a polynucleotide having at least 89% sequence identity to the mature polypeptide coding sequence of SEQ ID NO: 139;
(aq) a polypeptide encoded by a polynucleotide having at least 86% sequence identity to the mature polypeptide coding sequence of SEQ ID NO: 145;
(ar) a polypeptide encoded by a polynucleotide having at least 96.4% sequence identity to the mature polypeptide coding sequence of SEQ ID NO: 154;
(as) a polypeptide encoded by a polynucleotide having at least 80% sequence identity to the mature polypeptide coding sequence of SEQ ID NO: 160;
(at) a polypeptide encoded by a polynucleotide having at least 80% sequence identity to the mature polypeptide coding sequence of SEQ ID NO: 163;
(au) a polypeptide encoded by a polynucleotide having at least 80% sequence identity to the mature polypeptide coding sequence of SEQ ID NO: 166;
(av) a polypeptide encoded by a polynucleotide having at least 80% sequence identity to the mature polypeptide coding sequence of SEQ ID NO: 169;
(aw) a polypeptide encoded by a polynucleotide having at least 82% sequence identity to the mature polypeptide coding sequence of SEQ ID NO: 172;
(ax) a variant of SEQ ID NO: 12, wherein the variant has arabinofuranosidase activity and comprises one or more amino acid substitutions, and/or one or more amino acid deletions, and/or one or more amino acid insertions or any combination thereof in 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44 or 45 positions;
(ay) a variant of SEQ ID NO: 24, wherein the variant has arabinofuranosidase activity and comprises one or more amino acid substitutions, and/or one or more amino acid deletions, and/or one or more amino acid insertions or any combination thereof in 1, 2, 3, 4, 5, 6 or 7 positions;
(az) a variant of the polypeptide selected from the group consisting of SEQ ID NO: 27, SEQ ID NO: 54, SEQ ID NO: 60, SEQ ID NO: 108, SEQ ID NO: 114, SEQ ID NO: 120, SEQ ID NO: 126, SEQ ID NO: 162, SEQ ID NO: 165, SEQ ID NO: 168, SEQ ID NO: 171 or SEQ ID NO: 174 wherein the variant has arabinofuranosidase activity and comprises one or more amino acid substitutions, and/or one or more amino acid deletions, and/or one or more amino acid insertions or any combination thereof in 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 positions;
(ba) a variant of SEQ ID NO: 30, wherein the variant has arabinofuranosidase activity and comprises one or more amino acid substitutions, and/or one or more amino acid deletions, and/or one or more amino acid insertions or any combination thereof in 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42 or 43 positions;
(bb) a variant of SEQ ID NO: 36, wherein the variant has arabinofuranosidase activity and comprises one or more amino acid substitutions, and/or one or more amino acid deletions, and/or one or more amino acid insertions or any combination thereof in 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33 or 34 positions;
(bc) a variant of the polypeptide selected from the group consisting of SEQ ID NO: 48 or SEQ ID NO: 147 wherein the variant has arabinofuranosidase activity and comprises one or more amino acid substitutions, and/or one or more amino acid deletions, and/or one or more amino acid insertions or any combination thereof in 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41 or 42 positions;
(bd) a variant of SEQ ID NO: 66, wherein the variant has arabinofuranosidase activity and comprises one or more amino acid substitutions, and/or one or more amino acid deletions, and/or one or more amino acid insertions or any combination thereof in 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47 or 48 positions;
(be) a variant of SEQ ID NO: 105, wherein the variant has arabinofuranosidase activity and comprises one or more amino acid substitutions, and/or one or more amino acid deletions, and/or one or more amino acid insertions or any combination thereof in 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38 or 39 positions;
- (bf) a variant of the polypeptide selected from the group consisting of SEQ ID NO: 123 or SEQ ID NO: 141 wherein the variant has arabinofuranosidase activity and comprises one or more amino acid substitutions, and/or one or more amino acid deletions, and/or one or more amino acid insertions or any combination thereof in 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32 or 33 positions;
- (bg) a variant of SEQ ID NO: 138, wherein the variant has arabinofuranosidase activity and comprises one or more amino acid substitutions, and/or one or more amino acid deletions, and/or one or more amino acid insertions or any combination thereof in 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45 or 46 positions;
- (bh) a variant of SEQ ID NO: 156, wherein the variant has arabinofuranosidase activity and comprises one or more amino acid substitutions, and/or one or more amino acid deletions, and/or one or more amino acid insertions or any combination thereof in 1, 2, 3, 4, 5, 6, 7, 8, 9, 10 or 11 positions;
- (bi) a polypeptide comprising the polypeptide of (a), (b), (c), (d), (e), (f), (g), (h), (i), (j), (k), (l), (m), (n), (o), (p), (q), (r), (s), (t), (u), (v), (w), (x), (y), (z), (aa), (ab), (ac), (ad), (ae), (af), (ag), (ah), (ai), (aj), (ak), (al), (am), (an), (ao), (ap), (aq), (ar), (as), (at), (au), (av), (aw), (ax), (ay), (az), (ba), (bb), (bc), (bd), (be), (bf), (bg) or (bh) and a N-terminal and/or C-terminal His-tag and/or HQ-tag; and
- (bj) a fragment of the polypeptide of (a), (b), (c), (d), (e), (f), (g), (h), (i), (j), (k), (l), (m), (n), (o), (p), (q), (r), (s), (t), (u), (v), (w), (x), (y), (z), (aa), (ab), (ac), (ad), (ae), (af), (ag), (ah), (ai), (aj), (ak), (al), (am), (an), (ao), (ap), (aq), (ar), (as), (at), (au), (av), (aw), (ax), (ay), (az), (ba), (bb), (bc), (bd), (be), (bf), (bg), (bh) or (bi) having arabinofuranosidase activity and having at least 90% of the length of the mature polypeptide.

24. The polypeptide according to item 23, wherein the polypeptide comprises or consists of amino acids 1 to 303 of SEQ ID NO: 12, amino acids 1 to 302 of SEQ ID NO: 24, amino acids 1 to 309 of SEQ ID NO: 27, amino acids 1 to 438 of SEQ ID NO: 30, amino acids 1 to 446 of SEQ ID NO: 33, amino acids 1 to 438 of SEQ ID NO: 36, amino acids 1 to 446 of SEQ ID NO: 39, amino acids 1 to 302 of SEQ ID NO: 48, amino acids 1 to 311 of SEQ ID NO: 51, amino acids 1 to 364 of SEQ ID NO: 54, amino acids 1 to 373 of SEQ ID NO: 57, amino acids 1 to 436 of SEQ ID NO: 60, amino acids 1 to 444 of SEQ ID NO: 63, amino acids 1 to 302 of SEQ ID NO: 66, amino acids 1 to 311 of SEQ ID NO: 69, amino acids 1 to 302 of SEQ ID NO: 105, amino acids 1 to 464 of SEQ ID NO: 108, amino acids 1 to 472 of SEQ ID NO: 111, amino acids 1 to 364 of SEQ ID NO: 114, amino acids 1 to 372 of SEQ ID NO: 117, amino acids 1 to 357 of SEQ ID NO: 120, amino acids 1 to 302 of SEQ ID NO: 123, amino acids 1 to 453 of SEQ ID NO: 126, amino acids 1 to 461 of SEQ ID NO: 129, amino acids 1 to 309 of SEQ ID NO: 138, amino acids 1 to 304 of SEQ ID NO: 141, amino acids 1 to 312 of SEQ ID NO: 144, amino acids 1 to 302 of SEQ ID NO: 147, amino acids 1 to 316 of SEQ ID NO: 156, amino acids 1 to 303 of SEQ ID NO: 162, amino acids 1 to 361 of SEQ ID NO: 165, amino acids 1 to 373 of SEQ ID NO: 168, amino acids 1 to 302 of SEQ ID NO: 171 or amino acids 1 to 364 of SEQ ID NO: 174.

25. A composition comprising one or more polypeptides of any of items 23 to 24.

26. The composition of item 25 further comprising one or more GH10 or GH11 polypeptides having xylanase activity.

27. The composition of item 26, wherein the GH10 or GH11 polypeptide having xylanase activity is selected from the group consisting of:
- (a) a polypeptide having at least 80% sequence identity to the polypeptide of SEQ ID NO: 70;
- (b) a polypeptide having at least 80% sequence identity to the polypeptide of SEQ ID NO: 71;
- (c) a polypeptide having at least 80% sequence identity to the polypeptide of SEQ ID NO: 72;
- (d) a polypeptide having at least 80% sequence identity to the polypeptide of SEQ ID NO: 73;
- (e) a polypeptide having at least 80% sequence identity to the polypeptide of SEQ ID NO: 74;
- (f) a polypeptide having at least 80% sequence identity to the polypeptide of SEQ ID NO: 75;
- (g) a polypeptide having at least 80% sequence identity to the polypeptide of SEQ ID NO: 78;
- (h) a polypeptide having at least 80% sequence identity to the polypeptide of SEQ ID NO: 81;
- (i) a polypeptide having at least 80% sequence identity to the polypeptide of SEQ ID NO: 84;
- (j) a polypeptide having at least 80% sequence identity to the polypeptide of SEQ ID NO: 88;
- (k) a polypeptide having at least 80% sequence identity to the polypeptide of SEQ ID NO: 89;
- (l) a polypeptide having at least 80% sequence identity to the polypeptide of SEQ ID NO: 95;
- (m) a polypeptide having at least 80% sequence identity to the polypeptide of SEQ ID NO: 96;
- (n) a polypeptide having at least 80% sequence identity to the polypeptide of SEQ ID NO: 99;
- (o) a polypeptide having at least 80% sequence identity to the polypeptide of SEQ ID NO: 102;
- (p) a polypeptide having at least 80% sequence identity to the polypeptide of SEQ ID NO: 177;
- (q) a variant of the polypeptide selected from the group consisting of SEQ ID NO: 70, SEQ ID NO: 71, SEQ ID NO: 72, SEQ ID NO: 73, SEQ ID NO: 74, SEQ ID NO: 75, SEQ ID NO: 78, SEQ ID NO: 81, SEQ ID NO: 84, SEQ ID NO: 88, SEQ ID NO: 89, SEQ ID NO: 95, SEQ ID NO: 96, SEQ ID NO: 99, SEQ ID NO: 102 and SEQ ID NO: 177 wherein the variant has xylanase activity and comprises one or more amino acid substitutions, and/or one or more amino acid deletions, and/or one or more amino acid insertions or any combination thereof in 1, 2, 3, 4, 5, 6, 7, 8, 9 or 10 positions;
- (r) a polypeptide comprising the polypeptide of (a), (b), (c), (d), (e), (f), (g), (h), (i), (j), (k), (l), (m), (n), (o), (p) or (q) and a N-terminal and/or C-terminal His-tag and/or HQ-tag; and
- (s) a fragment of the polypeptide of (a), (b), (c), (d), (e), (f), (g), (h), (i), (j), (k), (l), (m), (n), (o), (p), (q) or (r) having xylanase activity and having at least 90% of the length of the mature polypeptide.

28. The composition according to item 27, wherein the GH10 or GH11 polypeptide having xylanase activity is selected from the group consisting of amino acids 1 to 384 of SEQ ID NO: 70, amino acids 1 to 288 of SEQ ID NO: 71, amino acids 1 to 308 of SEQ ID NO: 72, amino acids 1 to 195 of SEQ ID NO: 73, amino acids 1 to 203 of SEQ ID NO: 74, amino acids 1 to 182 of SEQ ID NO: 75, amino acids 1 to 183 of SEQ ID NO: 78, amino acids 1 to 181 of SEQ ID NO: 81, amino acids 1 to 299 of SEQ ID NO: 84, amino acids 1 to 307 of SEQ ID NO: 87, amino acids 1 to 188 of SEQ ID NO: 88, amino acids 1 to 189 of SEQ ID NO: 89, amino acids 1 to 328 of SEQ ID NO: 95, amino acids 1 to 208 of SEQ ID NO:96, amino acids 1 to 203 of SEQ ID NO:99, amino acids 1 to 337 of SEQ ID NO:102 or amino acids 1 to 323 of SEQ ID NO: 177.

29. The composition of any of items 1 to 22 or 25 to 28 further comprising one or more formulating agents.

30. The composition of item 29, wherein the one or more formulating agent is selected from the group consisting of glycerol, ethylene glycol, 1,2-propylene glycol or 1,3-propylene glycol, sodium chloride, sodium benzoate, potassium sorbate, sodium sulfate, potassium sulfate, magnesium sulfate, sodium thiosulfate, calcium carbonate, sodium citrate, dextrin, glucose, sucrose, sorbitol, lactose, starch and cellulose or any combination thereof.

31. The composition of any of items 1 to 22 or 25 to 30 further comprising one or more additional enzymes.

32. The composition of item 31, wherein the one or more additional enzymes is selected from the group consisting of phytase, xylanase, galactanase, alpha-galactosidase, protease, phospholipase A1, phospholipase A2, lysophospholipase, phospholipase C, phospholipase D, amylase, lysozyme, arabinofuranosidase, beta-xylosidase, acetyl xylan esterase, feruloyl esterase, cellulase, cellobiohydrolases, beta-glucosidase, pullulanase, and beta-glucanase or any combination thereof.

33. The composition of any of items 1 to 22 or 25 to 32 further comprising one or more microbes.

34. The composition of item 33, wherein the one or more microbes is selected from the group consisting of *Bacillus subtilis, Bacillus licheniformis, Bacillus amyloliquefaciens, Bacillus cereus, Bacillus pumilus, Bacillus polymyxa, Bacillus megaterium, Bacillus coagulans, Bacillus circulans, Bifidobacterium bifidum, Bifidobacterium animalis, Bifidobacterium* sp., *Carnobacterium* sp., *Clostridium butyricum, Clostridium* sp., *Enterococcus faecium, Enterococcus* sp., *Lactobacillus* sp., *Lactobacillus acidophilus, Lactobacillus farciminus, Lactobacillus rhamnosus, Lactobacillus reuteri, Lactobacillus salivarius, Lactococcus lactis, Lactococcus* sp., *Leuconostoc* sp., *Megasphaera elsdenii, Megasphaera* sp., *Pediococcus acidilactici, Pediococcus* sp., *Propionibacterium thoenii, Propionibacterium* sp. and *Streptococcus* sp. or any combination thereof.

35. The composition of any of items 1 to 22 or 25 to 34 further comprising plant based material from the sub-family Panicoideae.

36. The composition of item 35, wherein the plant based material from the sub-family Panicoideae is maize, corn, sorghum, switchgrass, millet, pearl millet, foxtail millet or in a processed form such as milled corn, milled maize, defatted maize, defatted destarched maize, milled sorghum, milled switchgrass, milled millet, milled foxtail millet, milled pearl millet, or any combination thereof.

37. The composition of any of items 35 to 36, wherein the plant based material from the sub-family Panicoideae is from the seed fraction (such as endosperm and/or husk) of the plant.

38. An animal feed additive comprising the composition of any of items 1 to 22 or 25 to 34 and one or more components selected from the list consisting of:
one or more vitamins;
one or more minerals;
one or more amino acids; and
one or more other feed ingredients.

39. An animal feed comprising the composition of any of items 1 to 22 or 25 to 34 or the animal feed additive of item 38 and plant based material from the sub-family Panicoideae.

40. The animal feed of item 39, wherein the plant based material from the sub-family Panicoideae is maize, corn, sorghum, switchgrass, millet, pearl millet, foxtail millet or in a processed form such as milled corn, milled maize, defatted maize, defatted destarched maize, milled sorghum, milled switchgrass, milled millet, milled foxtail millet, milled pearl millet, or any combination thereof.

41. The animal feed of any of items 39 to 40, wherein the plant based material from the sub-family Panicoideae is from the seed fraction (such as endosperm and/or husk) of the plant.

42. A method of improving one or more performance parameters of an animal comprising administering to one or more animals the composition of any of items 1 to 22 or 25 to 37, the animal feed additive of item 38 or an animal feed of any of items 39 to 41.

43. The method of item 42, wherein the performance parameter is selected from the list consisting of body weight gain, European Production Efficiency Factor (EPEF), European Production Efficacy Factor (EFF) and FCR.

44. A method of solubilising xylose from plant based material, comprising treating plant based material from the sub-family Panicoideae with the composition of any of items 1 to 22 or 25 to 37 or the animal feed additive of item 38.

45. A method of releasing starch from plant based material, comprising treating plant based material from the sub-family Panicoideae with the composition of any of items 1 to 22 or 25 to 37 or the animal feed additive of item 38.

46. A method for improving the nutritional value of an animal feed, comprising adding to the feed the composition of any of items 1 to 22 or 25 to 37 or the animal feed additive of item 38.

47. A method of preparing an animal feed, comprising mixing the composition of any of items 1 to 22 or 25 to 37 or the animal feed additive of item 38 with plant based material from the sub-family Panicoideae.

48. Use of the composition of any of items 1 to 22 or 25 to 37, the animal feed additive of item 38 or an animal feed of any of items 39 to 41:
in animal feed;
in animal feed additives;
in the preparation of a composition for use in animal feed;
for improving the nutritional value of an animal feed;
for increasing digestibility of the animal feed;
for improving one or more performance parameters in an animal;
for releasing xylose from plant based material of the sub-family Panicoideae; and/or
for releasing starch from plant based material of the sub-family Panicoideae.

49. An isolated polypeptide having xylanase activity, selected from the group consisting of:
(a) a polypeptide having at least 84% sequence identity to the polypeptide of SEQ ID NO: 84;

(b) a polypeptide having at least 80% sequence identity to the polypeptide of SEQ ID NO: 99;

(c) a polypeptide having at least 80% sequence identity to the polypeptide of SEQ ID NO: 102;

(d) a polypeptide encoded by a polynucleotide that hybridizes under high stringency conditions, or very high stringency conditions with
   (i) the mature polypeptide coding sequence of SEQ ID NO: 82,
   (ii) the mature polypeptide coding sequence of SEQ ID NO: 97,
   (iii) the mature polypeptide coding sequence of SEQ ID NO: 100,
   (iv) the full-length complementary strand of (i), (ii) or (iii);

(e) a polypeptide encoded by a polynucleotide having at least 84% sequence identity to the mature polypeptide coding sequence of SEQ ID NO: 82;

(f) a polypeptide encoded by a polynucleotide having at least 80% sequence identity to the mature polypeptide coding sequence of SEQ ID NO: 97;

(g) a polypeptide encoded by a polynucleotide having at least 80% sequence identity to the mature polypeptide coding sequence of SEQ ID NO: 100;

(h) a variant of the polypeptide selected from the group consisting of SEQ ID NO: 84, SEQ ID NO: 99 or SEQ ID NO: 102 wherein the variant has xylanase activity and comprises one or more amino acid substitutions, and/or one or more amino acid deletions, and/or one or more amino acid insertions or any combination thereof in 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 positions;

(i) a polypeptide comprising the polypeptide of (a), (b), (c), (d), (e), (f), (g), (h) or (i) and a N-terminal and/or C-terminal His-tag and/or HQ-tag; and (j) a fragment of the polypeptide of (a), (b), (c), (d), (e), (f), (g), (h), (i) or (j) having xylanase activity and having at least 90% of the length of the mature polypeptide.

50. The polypeptide according to item 49, wherein the polypeptide comprises or consists of amino acids 1 to 299 of SEQ ID NO: 84, amino acids 1 to 307 of SEQ ID NO: 87, amino acids 1 to 203 of SEQ ID NO:99 or amino acids 1 to 337 of SEQ ID NO:102.

51. A composition comprising one or more polypeptides of any of items 49 to 50.

52. The composition of item 51 further comprising one or more formulating agents.

53. The composition of item 52, wherein the one or more formulating agent is selected from the group consisting of glycerol, ethylene glycol, 1,2-propylene glycol or 1,3-propylene glycol, sodium chloride, sodium benzoate, potassium sorbate, sodium sulfate, potassium sulfate, magnesium sulfate, sodium thiosulfate, calcium carbonate, sodium citrate, dextrin, glucose, sucrose, sorbitol, lactose, starch and cellulose or any combination thereof.

54. The composition of any of items 51 to 53 further comprising one or more additional enzymes.

55. The composition of item 54, wherein the one or more additional enzymes is selected from the group consisting of phytase, xylanase, galactanase, alpha-galactosidase, protease, phospholipase A1, phospholipase A2, lysophospholipase, phospholipase C, phospholipase D, amylase, lysozyme, arabinofuranosidase, beta-xylosidase, acetyl xylan esterase, feruloyl esterase, cellulase, cellobiohydrolases, beta-glucosidase, pullulanase, and beta-glucanase or any combination thereof.

56. The composition of any of items 51 to 55 further comprising one or more microbes.

57. The composition of item 56, wherein the one or more microbes is selected from the group consisting of *Bacillus subtilis, Bacillus licheniformis, Bacillus amyloliquefaciens, Bacillus cereus, Bacillus pumilus, Bacillus polymyxa, Bacillus megaterium, Bacillus coagulans, Bacillus circulans, Bifidobacterium bifidum, Bifidobacterium animalis, Bifidobacterium* sp., *Carnobacterium* sp., *Clostridium butyricum, Clostridium* sp., *Enterococcus faecium, Enterococcus* sp., *Lactobacillus* sp., *Lactobacillus acidophilus, Lactobacillus farciminus, Lactobacillus rhamnosus, Lactobacillus reuteri, Lactobacillus salivarius, Lactococcus lactis, Lactococcus* sp., *Leuconostoc* sp., *Megasphaera elsdenii, Megasphaera* sp., *Pediococcus acidilactici, Pediococcus* sp., *Propionibacterium thoenii, Propionibacterium* sp. and *Streptococcus* sp. or any combination thereof.

58. The composition of any of items 51 to 57 further comprising plant based material from the sub-family Panicoideae.

59. The composition of item 58, wherein the plant based material from the sub-family Panicoideae is maize, corn, sorghum, switchgrass, millet, pearl millet, foxtail millet or in a processed form such as milled corn, milled maize, defatted maize, defatted destarched maize, milled sorghum, milled switchgrass, milled millet, milled foxtail millet, milled pearl millet, or any combination thereof.

60. The composition of any of items 58 to 59, wherein the plant based material from the sub-family Panicoideae is from the seed fraction (such as endosperm and/or husk) of the plant.

61. An animal feed additive comprising the composition of any of items 51 to 57 and one or more components selected from the list consisting of:
   one or more vitamins;
   one or more minerals;
   one or more amino acids; and
   one or more other feed ingredients.

62. An animal feed comprising the composition of any of items 51 to 60 or the animal feed additive of item 61 and plant based material from the sub-family Panicoideae.

63. The animal feed of item 62, wherein the plant based material from the sub-family Panicoideae is maize, corn, sorghum, switchgrass, millet, pearl millet, foxtail millet or in a processed form such as milled corn, milled maize, defatted maize, defatted destarched maize, milled sorghum, milled switchgrass, milled millet, milled foxtail millet, milled pearl millet, or any combination thereof.

64. The animal feed of any of items 62 to 63, wherein the plant based material from the sub-family Panicoideae is from the seed fraction (such as endosperm and/or husk) of the plant.

65. A polynucleotide encoding the polypeptide of any of items 23 to 24 or 49 to 50.

66. A nucleic acid construct or expression vector comprising the polynucleotide of item 65 operably linked to one or more control sequences that direct the production of the polypeptide in an expression host.

67. A recombinant host cell comprising the polynucleotide of item 65 operably linked to one or more control sequences that direct the production of the polypeptide.

68. A method of producing the polypeptide of any of items 23 to 24 or 49 to 50, comprising:

(a) cultivating a cell, which in its wild-type form produces the polypeptide, under conditions conductive for production of the polypeptide; and
(b) recovering the polypeptide.
69. A method of producing the polypeptide of any of items 23 to 24 or 49 to 50, comprising:
 (a) cultivating the recombinant host cell of item 67 under conditions conducive for production of the polypeptide; and
 (b) recovering the polypeptide.
70. A transgenic plant, plant part or plant cell transformed with a polynucleotide encoding the polypeptide of any of items 23 to 24 or 49 to 50.
71. A whole broth formulation or cell culture composition comprising a polypeptide of any of items 23 to 24 or 49 to 50.

The present invention is further described by the following examples that should not be construed as limiting the scope of the invention.

EXAMPLES

Strains

The sources of the strains are listed in table S1.

Genome sequencing, the subsequent assembly of reads and the gene discovery (i.e. annotation of gene functions) is known to the person skilled in the art and the service can be purchased commercially.

TABLE S1

Isolation of strains

| Strain | Source | Country | Year | Collection | SEQ ID NO of gene/ polypeptide |
|---|---|---|---|---|---|
| *Penicillium capsulatum* | Ground germlings | Pakistan | 1962 | CBS 292.62 | 7/8 |
| *Penicillium polonicum* (formally *P. aurantiogriseum*) | Maize | Pretoria, South Africa | On or before 1990 | CBS 228.90 | 10/11 |
| *Aspergillus clavatus* | Not reported | Not reported | On or before 1965 | NRRL 1 CBS 513.65 | 13/14 40/41 |
| *Neosartorya fischeri* | Canned fruit (apples) | Not reported | 1923 | NRRL181 CBS 544.65 | 16/17 157/158 |
| *Ustilago maydis* | Corn stem | USA | On or before 1961 | FGSC9021 | 19/20 175/176 |
| *Penicillium oxalicum* | Soil sample | Beijing, China | 2006 | | 22/23 |
| *Talaromyces pinophilus* | Soil sample | Yunnan, China | 2000 | | 25/26 |
| *Streptomyces nitrosporeus* | Garden soil sample | Japan | 1952 | ATCC 12769 DSM 40023 | 28/29 |
| *Aspergillus wentii* | Soybeans | Java | On or before 1907 | CBS104.07 | 46/47 |
| *Acrophialophora fusispora* | Forest soil | Patharia Forest, India | 1955 | CBS380.55 ATCC 22556 | 52/53 64/65 |
| *Streptosporangium* sp-60756 | Soil sample | India | On or before 1993 | | 58/59 |
| *Lasiodiplodia theobromae* | Soil sample | Yunnan, China | 1990 | | 97/98 |
| *Ascobolus stictoideus* A4-1 | Deer dung | Denmark | On or before 1991 | | 100/101 |
| *Drechslera* sp. | Soil sample | Egypt | On or before 1994 | | 103/104 |
| *Xylanibacterium* sp-61981 | Environmental sample | United Kingdom | 1990 | | 106/107 |
| *Microdochium nivale* | | India | 1996 | | 112/113 |
| *Humicola hyalothermophila* | Soil sample | Jordan | On or before 1980 | CBS 454.80 | 118/119 |
| *Curvularia geniculate* | *Setaria italica* | USA | On or before 1964 | CBS 332.64 | 121/122 |
| *Glycomyces rutgersensis* | Soil sample | China | 1985 | DSM 43812 | 124/125 |
| *Coprinopsis cinerea* | Environmental sample | Japan | 1991 | FGSC9003 | 130/131 |
| *Aspergillus aculeatus* | Wood of *Santalum* sp. | Not disclosed | On or before 1943 | CBS 101.43 DSM 2344 | 136/137 |
| *Remersonia thermophila* | Mushroom compost | Switzerland | 1962 | CBS540.69 | 139/140 |
| *Penicillium soppii* | Leaf sample | Sweden | 1994 | | 145/146 |
| *Bipolaris sorokiniana* | Stem of a Triticale plant | Ethiopia | On or before 1988 | IMI 325070 | 148/149 |
| *Aspergillus fumigatiaffinis* | Soil sample | USA | 1989 | CBS 117186 | 154/155 |
| *Thielavia arenaria* | Desert soil | Egypt | On or before 1974 | CBS 508.74 | 160/161 |
| *Chaetomium olivicolor* | Garden soil | India | 1996 | CBS 102434 | 163/164 |

TABLE S1-continued

Isolation of strains

| Strain | Source | Country | Year | Collection | SEQ ID NO of gene/ polypeptide |
|---|---|---|---|---|---|
| *Thielavia terricola* | Winter pea plans | Not reported | On or before 1950 | CBS 540.50 | 166/167 169/170 |
| *Humicola* sp. | Soil sample | Egypt | On or before 1993 | | 172/173 |

The origin of the GH11 xylanase from *Geobacillus stearothermophilus* (SEQ ID NO: 76) was not reported in 'Nucleotide sequence analysis of an endo-xylanase gene (xynA) from *Bacillus stearothermophilus*', *J. Microbiol Biotechnol.* 1995 5:117-124.

Preparation of Substrates

Preparation of Destarched Maize (DSM)

107 kg of milled maize (<10 mm) was mixed in a tank with 253 kg of tap water at 53° C. to make a slurry. The temperature of the slurry was 47° C. and the pH 5.9. The pH was adjusted to 6.15 with 1 L of 1 N NaOH and the tank was then heated to 95° C. 1.119 kg of Termamyl® alpha-amylase (Novozymes A/S, Bagsvaerd, Denmark) was added at 52° C. and incubated for 80 minutes at 95° C. The pH measured at the end of the incubation was 6.17. Cold tap water was added to the slurry and the slurry was centrifuged and decanted 3 times using a Westfalia decanter CA-225-110 (4950±10 rpm, flow ~600 l/h) giving 64.5 kg of sludge. The sludge was then collected, frozen and freeze-dried to give 17.1 kg of destarched maize (DSM).

Preparation of Defatted Destarched Maize (DFDSM)

500 mL acetone was added to 100 gram of destarched maize, prepared as described above. The slurry was stirred for 5 minutes and allowed to settle. The acetone was decanted and the procedure was repeated 2 times. The residue was air dried overnight to give defatted destarched maize (DFDSM) which was stored at room temperature.

Preparation of Destarched Sorghum

Whole sorghum seeds were milled and sieved and a fraction below 0.5 mm was used for further processing. The sieved fraction was suspended in 25 mM NaOAc pH 5.5 at 20% dry matter and destarched. The destarching involved a first step at 85° C. with 500 ppm Termamyl SC alpha-amylase (Novozymes A/S, Bagsvaerd, Denmark) for 20 min followed by an overnight incubation using 250 ppm Attenuzyme Flex (Novozymes A/S, Bagsvaerd, Denmark) at 65° C. The slurry was centrifuged and the liquid decanted. After this another destarching was made using by adding MilliQ water and 200 ppm Termamyl SC and 200 ppm Attenuzyme Flex and incubating overnight at 65° C.

The sorghum fiber was separated from the liquid by vacuum filtration through a Whatman F glass fiber filter. The filter cake was then washed several times with excess of water to remove soluble sugars. Finally the destarched sorghum fiber was dried in an oven at 65° C. and the dry fiber milled quickly in a coffee grinder so that the particle size was in general less than 1 mm.

Assays

Xylose Assay

A xylose standard curve from 0 to 125 µg xylose/mL was prepared from a stock solution of 2.5 mg xylose/mL (prepared by dissolving 0.125 g xylose in 50 mL de-ionised water).

Assay principle. The interconversion of the α- and β-anomeric forms of D-xylose is catalysed by xylose mutarotase (XMR) using the D-xylose assay kit from Megazyme International Ireland. The β-D-xylose is oxidised by NAD+ to D-xylonic acid in the presence of β-xylose dehydrogenase (β-XDH) at pH 7.5. The amount of NADH formed in this reaction is stoichiometric with the amount of D-xylose and is measured by the increase in absorbance at 340 nm.

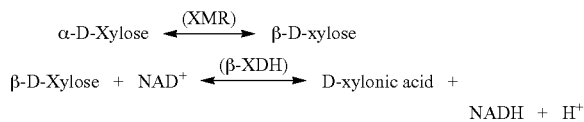

Example 1: GH62 Arabinofuranosidase from *Penicillium capsulatum* (SEQ ID NO: 9)

The GH62 arabinofuranosidase from *Penicillium capsulatum* (SEQ ID NO: 9) was cloned, expressed and purified as described in WO2006/125438.

Example 2: Cloning of GH62 Arabinofuranosidase from *Penicillium aurantiogriseum* (SEQ ID NO: 12)

The arabinofuranosidase with nucleotide sequence SEQ ID NO: 10 was PCR amplified from genomic DNA isolated from *Penicillium aurantiogriseum* and cloned into the expression vector pDAu222 using BamHI and HindIII restriction sites as described in WO 2013024021.

The final expression plasmids were individually transformed into the *Aspergillus oryzae* Bech2 expression host. Host organism *Aspergillus oryzae* BECh2 is described in WO 00/39322. It is a mutant of JaL228 (described in WO98/123000), which is a mutant of IF04177. The arabinofuranosidase genes were integrated by ectopic integration into the *A. oryzae* bech2 host cell genome upon transformation.

The gene coding for amdS was used as marker. Transformants were selected on sucrose media agar supplemented with 10 mM acetamide. For production of the recombinant arabinofuranosidase, a single *Aspergillus* transformant was cultured in 18 500 ml baffled flasks each containing 150 ml of DAP-4C-1 medium (WO 12/103350). The cultures were shaken on a rotary table at 200 RPM at 30° C. for 3 days. The culture broth subsequently was separated from cellular material by filtration through a stack of filters with 1.6, 1.2, and 0.7 um pore sizes, followed by passage through a 0.45 um filter.

Example 3: Purification of GH62 Arabinofuranosidase from *Penicillium aurantiogriseum* (SEQ ID NO: 12)

The filtrated broth from example 2 was adjusted to pH8.0 and filtrated on 0.22 µm PES filter (Nalge Nunc International, Nalgene labware cat #595-4520). The filtrate was loaded onto a MEP Hypercel™ column (Pall Corporation, Long Island, N.Y., USA) equilibrated with 50 mM TRIS pH8.0. After wash with equilibration buffer, the bound proteins were batch eluted with 50 mM acetic acid pH 4.5. Fractions were collected and analyzed by SDS-PAGE. The fractions were applied to a SP SEPHAROSE® Fast Flow column (GE Healthcare, Piscataway, N.J., USA) equilibrated with 50 mM acetic acid pH 4.5 and bound proteins were eluted with a linear gradient from 0-1000 mM sodium chloride over 20 CV. Fractions were collected and analyzed by SDS-PAGE.

Example 4: Cloning of GH62 Arabinofuranosidases from *Aspergillus clavatus* (SEQ ID NO: 15), *Neosartorya fischeri* (SEQ ID NO: 18) and *Ustilago maydis* (SEQ ID NO: 21)

The wild type genes from *Aspergillus clavatus* (Uniprot: XM_001273614), *Neosartorya fischeri* (Uniprot: XM_001265651) and *Ustilago maydis* (Uniprot: XM_755363) were codon optimized for *Aspergillus oryzae* giving nucleotide sequences SEQ ID NO: 13, SEQ ID NO: 16 and SEQ ID NO: 19 respectively which were synthesized and purchased commercially (Geneart and Lifetechnologies). *E. coli* DH10B competent cells were transformed with a construct including the gene as described above for re-constitution and maintenance.

The final expression plasmids were individually transformed into the *Aspergillus oryzae* MT3568 expression host. *A. oryzae* MT3568 is a derivative of *A. oryzae* JaL355 (WO02/40694) in which pyrG auxotrophy was restored by disrupting the *A. oryzae* acetamidase (amdS) gene with the pyrG gene. The arabinofuranosidase genes were integrated by homologous recombination into the *A. oryzae* MT3568 host cell genome upon transformation.

The gene coding for amdS was used as marker. Transformants were selected on sucrose agar plate supplemented with 10 mM acetamide. One recombinant *Aspergillus oryzae* clone containing the respective arabinofuranosidase expression construct was selected and was cultivated on a rotary shaker in 3* 1-liter baffled conical flasks each containing 300 ml DAP4C-1 (DAP4C-1 medium was composed of 11 g of $MgSO_4.7H_2O$, 1 g $KH_2PO_4$, 2 g of citric acid, monohydrate, 20 g of dextrose, 10 g of maltose, 6 g of $K_3PO_4.3H_2O$, 0.5 g of yeast extract, 0.5 ml of trace metals solution, and deionized water to 1 liter. The medium was portioned out to flasks, adding 1 gram $CaCO_3$ to each 300 ml portion. The medium was sterilized in an autoclave. After cooling the following was added to 300 ml of medium: 7 ml of filter sterilized 50% w/v $(NH_4)_2HPO_4$, and 10 ml of filter sterilized 20% lactic acid). After 3 days cultivation time at 30° C., 180 rpm enzyme containing supernatants were harvested by filtration using a 0.22 µm 1-liter bottle (Borosil) top vacuum filter (GE Healthcare).

Example 5: Purification of GH62 Arabinofuranosidases from *Aspergillus clavatus* (SEQ ID NO: 15), *Neosartorya fischeri* (SEQ ID NO: 18) and *Ustilago maydis* (SEQ ID NO: 21)

The filtrate from example 4 was pH adjusted to pH 7, loaded onto a Toyopearl Phenyl-650 resin column (Tosoh Bioscience) and equilibrated with equilibration buffer (ammonium sulfate (1.5M)+HEPES (50 mM, pH 7)). After washing with equilibration buffer, the bound proteins were batch eluted with 0.9M Ammonium Sulphate in HEPES (50 mM, pH 7). Fractions were collected and analyzed by SDS-PAGE. Fractions containing a band at approximately 41 kDa (SEQ ID NO: 15 and SEQ ID NO: 18) or 34 kDa (SEQ ID NO: 21) were pooled. The sample was buffer exchanged with HEPES (50 mM, pH 7) and concentrated using a Quixstand fitted with a 10 KDa cutoff membrane.

Example 6: Cloning of GH62 Arabinofuranosidases from *Penicillium oxalicum* (SEQ ID NO: 24) and *Talaromyces pinophilus* (SEQ ID NO: 27)

The arabinofuranosidases with nucleotide sequences SEQ ID NO: 22 and SEQ ID NO: 25 were PCR amplified from genomic DNA isolated from *Penicillium oxalicum* and *Talaromycespinophilus* respectively and cloned into the expression vector pCaHj505 as described in WO2013029496.

The final expression plasmids were individually transformed into the *Aspergillus oryzae* MT3568 expression host. *A. oryzae* MT3568 is a derivative of *A. oryzae* JaL355 (WO02/40694) in which pyrG auxotrophy was restored by disrupting the *A. oryzae* acetamidase (amdS) gene with the pyrG gene. The arabinofuranosidase genes were integrated by homologous recombination into the *A. oryzae* MT3568 host cell genome upon transformation.

The gene coding for amdS was used as marker. Transformants were selected on pyrG media agar supplemented with 10 mM acetamide. One recombinant *Aspergillus oryzae* clone containing the respective arabinofuranosidase expression construct was selected and was cultivated on a rotary shaking table in 4 2-liter baffled Erlenmeyer flasks each containing 400 ml YPM (1% Yeast extract, 2% Peptone and 2% Maltose). After 3 days cultivation time at 30° C., enzyme containing supernatants were harvested by filtration using a 0.22 µm 1-liter bottle top vacuum filter (Corning Inc., Corning, N.Y., USA).

Example 7: Purification of GH62 Arabinofuranosidases from *Penicillium oxalicum* (SEQ ID NO: 24) and *Talaromyces pinophilus* (SEQ ID NO: 27)

A 1600 ml volume of filtered supernatant of *Aspergillus oryzae* from example 6 was precipitated with ammonium sulfate (80% saturation), re-dissolved in 50 ml of 20 mM NaOAc pH 5.5, dialyzed against the same buffer, and filtered through a 0.45 µm filter. The final volume was 60 ml. The solution was applied to a 40 ml Q SEPHAROSE® Fast Flow column (GE Healthcare, Buckinghamshire, UK) equilibrated with 20 mM NaOAc pH 5.5. Proteins were eluted with a linear 0-0.25 M NaCl gradient. Fractions were analyzed by SDS-PAGE using a NUPAGE® NOVEX® 4-12% Bis-Tris Gel with 50 mM MES. The resulting gel was stained with INSTANTBLUE™. Fractions containing a band at approximately 33 kDa were pooled. Then the pooled solution was concentrated by ultrafiltration.

Example 8: Cloning of GH62 Arabinofuranosidase from *Streptomyces nitrosporeus* (SEQ ID NO: 33), *Streptomyces beijiangensis* (SEQ ID NO: 39) and *Streptosporangium* sp-60756 (SEQ ID NO: 63)

Bacterial GH62 sequences were cloned from *Streptomyces nitrosporeus* (SEQ ID NO: 28), *Streptomyces beijiangensis* (SEQ ID NO: 34) and *Streptosporangium* sp-60756 (SEQ ID NO: 58).

The AraFs were cloned into a *Bacillus* expression vector as described in WO 12/025577. The DNA encoding the mature AraF peptide were cloned in frame to a *Bacillus clausii* secretion signal (BcSP; with the following amino acid sequence: MKKPLGKIVASTALLISVAFSSSIASA (SEQ ID NO: 90)). BcSP replaced all native secretion signals respectively in all genes.

Downstream of the BcSP sequence an affinity tag sequence was introduced to ease the purification process (His-tag; with the following amino acid sequence: HHHHHHPR (SEQ ID NO: 92) The gene that was expressed therefore comprised the BcSP sequence followed by the His-tag sequence followed by the mature wild type AraF sequence (as shown in SEQ ID NO: 31, SEQ ID NO: 37 and SEQ ID NO: 61 respectively).

The final expression plasmids (BcSP-His-tag-GH62) were individually transformed into a *Bacillus subtilis* expression host. The AraF BcSP-fusion genes were integrated by homologous recombination into the *Bacillus subtilis* host cell genome upon transformation.

The gene construct was expressed under the control of a triple promoter system (as described in WO 99/43835). The gene coding for chloramphenicol acetyltransferase was used as maker (as described in (Diderichsen et al., 1993, *Plasmid* 30: 312-315)). Transformants were selected on LB media agar supplemented with 6 microgram of chloramphenicol per ml. One recombinant *Bacillus subtilis* clone containing the respective arabinofuranosidase expression construct was selected and was cultivated on a rotary shaking table in 500 ml baffled Erlenmeyer flasks each containing 100 ml yeast extract-based media. After 3-5 days cultivation time at 30° C. to 37° C., enzyme containing supernatants were harvested by centrifugation and the enzymes were purified by His-tag purification.

Example 9: Purification of GH62 Arabinofuranosidase from *Streptomyces nitrosporeus* (SEQ ID NO: 33), *Streptomyces beijiangensis* (SEQ ID NO: 39) and *Streptosporangium* sp-60756 (SEQ ID NO: 63)

The His-tagged enzymes from example 8 were purified by immobilized metal chromatography (IMAC) using Ni2+ as the metal ion on 5 mL HisTrap Excel columns (GE Healthcare Life Sciences). The purification took place at pH 8 and the bound proteins were eluted with imidazole. The purity of the purified enzymes was checked by SDS-PAGE and the concentration of each enzyme determined by Abs 280 nm after a buffer exchange.

Example 10: Cloning of GH62 Arabinofuranosidase from *Aspergillus clavatus* (SEQ ID NO: 45)

The arabinofuranosidase with nucleotide sequence SEQ ID NO: 40 was PCR amplified from genomic DNA isolated from *Aspergillus clavatus* and cloned into the *Aspergillus* expression vector pMStr366. The vector pMStr366 is a version of the expression vector pMStr57 (WO 04/032648) that has been modified to allow fusion of an insert CDS to a vector-encoded HIS tag with the sequence RHHHHHHP (SEQ ID NO: 91). The nucleotide sequence of the resulting fusion is shown in SEQ ID NO: 43 and the peptide translation of the His-tagged protein is shown in SEQ ID NO: 44.

The sequence of the tagged arabinofuranosidase encoding gene cloned in the expression vector was confirmed and the expression construct was transformed into the *Aspergillus oryzae* strain MT3568 (WO 11/057140). Transformants were selected on acetamide during regeneration from protoplasts and subsequently re-isolated under selection (Christensen et al., 1988, *Biotechnology* 6, 1419-1422 and WO 04/032648).

For production of the recombinant arabinofuranosidase, a single *Aspergillus* transformant was cultured in two 500 ml baffled flasks each containing 150 ml of DAP-4C-1 medium (WO 12/103350). The cultures were shaken on a rotary table at 150 RPM at 30° C. for 3 days. The culture broth subsequently was separated from cellular material by passage through a 0.22 um filter.

Example 11: Purification of the Arabinofuranosidase from *Aspergillus clavatus* (SEQ ID NO: 45)

The pH of the filtrated sample from example 10 was adjusted to around pH 7.5 and 1.8M ammonium sulfate was added. The sample was applied to a 5 ml HiTrap™ Phenyl (HS) column on an Akta Explorer. Prior to loading, the column had been equilibrated in 5 column volumes (CV) of 50 mM HEPES+1.8M ammonium sulfate pH 7. In order to remove unbound material, the column was washed with 5 CV of 50 mM HEPES+1.8M ammonium sulfate pH 7. The target protein was eluted from the column into a 10 ml loop using 50 mM HEPES+20% isopropanol pH 7. From the loop, the sample was loaded onto a desalting column (HiPrep™ 26/10 Desalting), which had been equilibrated with 3CV of 50 mM HEPES+100 mM NaCl pH 7.0. The target protein was eluted with 50 mM HEPES+100 mM NaCl pH 7.0 and relevant fractions were selected and pooled based on the chromatogram. The flow rate was 5 ml/min.

Example 12: Cloning of GH62 Arabinofuranosidase from *Aspergillus wentii* (SEQ ID NO: 51)

The arabinofuranosidase with nucleotide sequence SEQ ID NO: 46 was PCR amplified from genomic DNA isolated from *Aspergillus wentii* and cloned into the expression vector pDAu222 as described in WO 2013024021 using BamHI and MluI restriction sites to create a C-terminal His-tag fusion construct with the nucleotide sequence shown in SEQ ID NO: 49 and the peptide translation of the His-tagged protein shown in SEQ ID NO: 50.

The sequence of the tagged arabinofuranosidase encoding gene cloned in the expression vector was confirmed and the expression construct was transformed into the *Aspergillus oryzae* strain MT3568 (WO 11/057140). Transformants were selected on acetamide during regeneration from protoplasts and subsequently re-isolated under selection (Christensen et al., 1988, *Biotechnology* 6, 1419-1422 and WO 04/032648).

For production of the recombinant arabinofuranosidase, a single *Aspergillus* transformant was cultured in two 500 ml baffled flasks each containing 150 ml of DAP-4C-1 medium (WO 12/103350). The cultures were shaken on a rotary table at 150 RPM at 30° C. for 3 days. The culture broth subsequently was separated from cellular material by passage through a 0.22 um filter.

Example 13: Purification of GH62 Arabinofuranosidase from *Aspergillus wentii* (SEQ ID NO: 51)

The filtrated broth from example 12 was adjusted to pH8.0 and filtrated on 0.22 μm PES filter (Nalge Nunc International, Nalgene labware cat #595-4520). The filtrate was loaded onto a MEP Hypercel™ column (Pall Corporation, Long Island, N.Y., USA) equilibrated with 50 mM TRIS pH8.0. After wash with equilibration buffer, the bound proteins were batch eluted with 50 mM acetic acid pH 4.5. Fractions were collected and analyzed by SDS-PAGE. The fractions were applied to a SP SEPHAROSE® Fast Flow column (GE Healthcare, Piscataway, N.J., USA) equilibrated with 50 mM acetic acid pH 4.5 and bound proteins were eluted with a linear gradient from 0-1000 mM sodium chloride over 20 CV. Fractions were collected and analyzed by SDS-PAGE.

Example 14: Cloning of GH62 Arabinofuranosidase from *Acrophialophora fusispora* (SEQ ID NO: 57)

The arabinofuranosidase with nucleotide sequence SEQ ID NO: 52 was PCR amplified from genomic DNA isolated from Acrophialophora fusispora and cloned into the expression vector pDAu222 as described in WO 2013024021 using BamHI and MluI restriction sites to create a C-terminal His-tag fusion construct with the nucleotide sequence shown in SEQ ID NO: 55 and the peptide translation of the His-tagged protein shown in SEQ ID NO: 56.

The sequence of the tagged arabinofuranosidase encoding gene cloned in the expression vector was confirmed and the expression construct was transformed into the *Aspergillus oryzae* strain MT3568 (WO 11/057140). Transformants were selected on acetamide during regeneration from protoplasts and subsequently re-isolated under selection (Christensen et al., 1988, *Biotechnology* 6, 1419-1422 and WO 04/032648).

For production of the recombinant arabinofuranosidase, a single *Aspergillus* transformant was cultured in two 500 ml baffled flasks each containing 150 ml of DAP-4C-1 medium (WO 12/103350). The cultures were shaken on a rotary table at 150 RPM at 30° C. for 3 days. The culture broth subsequently was separated from cellular material by passage through a 0.22 um filter.

Example 15: Purification of GH62 Arabinofuranosidase from *Acrophialophora fusispora* (SEQ ID NO: 57)

The filtrated broth from example 14 was adjusted to pH8.0 and filtrated on 0.22 μm PES filter (Nalge Nunc International, Nalgene labware cat #595-4520). The filtrate was loaded onto a MEP Hypercel™ column (Pall Corporation, Long Island, N.Y., USA) equilibrated with 50 mM TRIS pH8.0. After wash with equilibration buffer, the bound proteins were batch eluted with 50 mM acetic acid pH 4.5. Fractions were collected and analyzed by SDS-PAGE. The fractions were applied to a SP SEPHAROSE® Fast Flow column (GE Healthcare, Piscataway, N.J., USA) equilibrated with 50 mM acetic acid pH 4.5 and bound proteins were eluted with a linear gradient from 0-1000 mM sodium chloride over 20 CV. Fractions were collected and analyzed by SDS-PAGE.

Example 16: Cloning of GH62 Arabinofuranosidase from *Acrophialophora fusispora* (SEQ ID NO: 69)

The arabinofuranosidase with nucleotide sequence SEQ ID NO: 64 was PCR amplified from genomic DNA isolated from *Acrophialophora fusispora* and cloned into the expression vector pDAu222 as described in WO 2013024021 using BamHI and MluI restriction sites to create a C-terminal His-tag fusion construct with the nucleotide sequence shown in SEQ ID NO: 67 and the peptide translation of the His-tagged protein shown in SEQ ID NO: 68.

The sequence of the tagged arabinofuranosidase encoding gene cloned in the expression vector was confirmed and the expression construct was transformed into the *Aspergillus oryzae* strain MT3568 (WO 11/057140). Transformants were selected on acetamide during regeneration from protoplasts and subsequently re-isolated under selection (Christensen et al., 1988, *Biotechnology* 6, 1419-1422 and WO 04/032648).

For production of the recombinant arabinofuranosidase, a single *Aspergillus* transformant was cultured in two 500 ml baffled flasks each containing 150 ml of DAP-4C-1 medium (WO 12/103350). The cultures were shaken on a rotary table at 150 RPM at 30° C. for 3 days. The culture broth subsequently was separated from cellular material by passage through a 0.22 um filter.

Example 17: Purification of GH62 Arabinofuranosidase from *Acrophialophora fusispora* (SEQ ID NO: 69)

The filtrated broth from example 16 was adjusted to pH8.0 and filtrated on 0.22 μm PES filter (Nalge Nunc International, Nalgene labware cat #595-4520). The filtrate was loaded onto a MEP Hypercel™ column (Pall Corporation, Long Island, N.Y., USA) equilibrated with 50 mM TRIS pH8.0. After wash with equilibration buffer, the bound proteins were batch eluted with 50 mM acetic acid pH 4.5. Fractions were collected and analyzed by SDS-PAGE. The fractions were applied to a SP SEPHAROSE® Fast Flow column (GE Healthcare, Piscataway, N.J., USA) equilibrated with 50 mM acetic acid pH 4.5 and bound proteins were eluted with a linear gradient from 0-1000 mM sodium chloride over 20 CV. Fractions were collected and analyzed by SDS-PAGE.

Example 18: Cloning of the GH11 Xylanase 1 from *Geobacillus stearothermophilus* (SEQ ID NO: 81)

The GH11 xylanase 1 gene from *Geobacillus stearothermophilus* has been published by Cho, S and Choi, Y (Nucleotide sequence analysis of an endo-xylanase gene (xynA) from *Bacillus stearothermophilus, J Microbiol Biotechnol.* 1995 5:117-124 (UNIPROT:P45705)). The gene encoding the GH11 xylanase 1 from *Geobacillus stearothermophilus* was cloned as a codon optimised synthetic gene based on the published nucleotide sequence (SEQ ID NO: 76). The synthetic gene having SEQ ID NO: 79, was synthesized by the company DNA2.0 (Headquarter, 1430 O'Brien Drive, Suite E, Menlo Park, Calif. 94025, USA). The synthetic gene was delivered as a cloned fragment in their standard cloning vector. A linear integration vector-system was used for the expression cloning of the GH11 xylanase 1 from *Geobacillus stearothermophilus*. The linear integration construct was a PCR fusion product made by fusion of the gene between two *Bacillus subtilis* homologous chromosomal regions along with a strong promoter and a chloramphenicol resistance marker. The fusion was made by SOE PCR (Horton, R. M., Hunt, H. D., Ho, S. N., Pullen, J. K. and Pease, L. R. (1989) Engineering hybrid genes without the use of restriction enzymes, gene splicing by overlap extension *Gene* 77: 61-68). The SOE PCR method is also described in patent application WO 2003095658. The gene was expressed under the control of a triple promoter system (as described in WO 99/43835), consisting of the promoters from *Bacillus licheniformis* alpha-amylase gene (amyL), *Bacillus amyloliquefaciens* alpha-amylase gene (amyQ), and the *Bacillus thuringiensis* cryIIIA promoter including stabilizing sequence. The gene coding for chloramphenicol acetyl-transferase was used as marker (described in e.g. Diderichsen, B.; Poulsen, G. B.; Joergensen, S. T.; A useful cloning vector for *Bacillus subtilis*. Plasmid 30:312 (1993)). The final gene constructs were integrated on the *Bacillus* chromosome by homologous recombination into the pectate lyase locus. The gene was amplified by PCR from the plasmid delivered by the company DNA2.0 with gene specific primers containing overhang to the two flanking fragments. The upstream and downstream flanking fragments were amplified from genomic DNA of the strain iMB1361 (described in patent application WO 2003095658). The GH11 xylanase 1 was expressed with a *Bacillus lentus* secretion signal (with the following amino acid sequence: MKKPLGKIVASTALLISVAFSSSIASA (SEQ ID NO: 90)) replacing the native secretion signal. The resulting expressed gene sequence is SEQ ID NO: 79. The 2 linear vector fragments and the gene fragment was subjected to a Splicing by Overlap Extension (SOE) PCR reaction to assemble the 3 fragments into one linear vector construct. An aliquot of the PCR product was transformed into *Bacillus subtilis*. Transformants were selected on LB plates supplemented with 6 μg of chloramphenicol per ml. A recombinant *Bacillus subtilis* clone containing the integrated expression construct was grown in liquid culture. The enzyme containing supernatant was harvested and the enzyme purified as described in example 19.

Example 19: Purification of the GH11 Xylanase 1 from *Geobacillus stearothermophilus* (SEQ ID NO: 81)

Filtrated broth was adjusted to pH8.0 and filtrated on 0.22 μm PES filter (Nalge Nunc International, Nalgene labware cat #595-4520). The filtrate was loaded onto a MEP Hypercel™ column (Pall Corporation, Long Island, N.Y., USA) equilibrated with 50 mM TRIS pH8.0. After wash with equilibration buffer, the bound proteins were batch eluted with 100 mM acetic acid pH 4.5. Fractions were collected and analyzed by SDS-PAGE. The fractions were pooled and applied to a Sephadex™ G-25 (medium) (GE Healthcare, Piscataway, N.J., USA) column equilibrated in 20 mM MES pH 6.0. The fractions were then applied to a SP SEPHAROSE® Fast Flow column (GE Healthcare, Piscataway, N.J., USA) equilibrated with 20 mM MES pH 6.0 and bound proteins were eluted with a linear gradient from 0-1000 mM sodium chloride over 20 CV. Fractions were collected and analyzed by SDS-PAGE.

Example 20: Cloning of the GH11 Xylanase from *Streptomyces beijiangensis* (SEQ ID NO: 87)

Bacterial xylanase sequence was cloned from *Streptomyces beijiangensis* (SEQ ID NO: 82). The xylanase was cloned into a *Bacillus* expression vector as described in WO 12/025577. The DNA encoding the mature xylanase peptide was cloned in frame to a *Bacillus clausii* secretion signal (BcSP; with the following amino acid sequence: MKKPLGKIVASTALLISVAFSSSIASA (SEQ ID NO: 90), originating from the protease AprH of *B. clausii*). BcSP replaced the native secretion signal.

Downstream of the BcSP sequence an affinity tag sequence was introduced (His-tag; with the following amino acid sequence: HHHHHHPR (SEQ ID NO: 92). The gene that was expressed therefore comprised the BcSP sequence followed by the His-tag sequence followed by the mature wild type xylanase sequence (as shown in SEQ ID NO: 85).

The final expression plasmid (BcSP-His-tag-GH11) was transformed into a *Bacillus subtilis* expression host. The Xyl BcSP-fusion genes were integrated by homologous recombination into the *Bacillus subtilis* host cell genome upon transformation.

The gene construct was expressed under the control of a triple promoter system (as described in WO 99/43835). The gene coding for chloramphenicol acetyltransferase was used as maker (as described in (Diderichsen et al., 1993, Plasmid 30: 312-315)). Transformants were selected on LB media agar supplemented with 6 microgram of chloramphenicol per ml. One recombinant *Bacillus subtilis* clone containing the respective xylanase expression construct was selected and was cultivated on a rotary shaking table in 500 ml baffled Erlenmeyer flasks each containing 100 ml yeast extract-based media. After 3-5 days cultivation time at 30° C. to 37° C., enzyme containing supernatants were harvested by centrifugation and the enzyme purified as described in example 21.

Example 21: Purification of the GH11 Xylanase from *Streptomyces beijiangensis* (SEQ ID NO: 87)

Filtrated broth was applied to a Sephadex™ G-25 (medium) (GE Healthcare, Piscataway, N.J., USA) column equilibrated in 100 mM sodium acetate pH 5.0, 5 mM $CaCl_2$. The fractions were pooled and added an equal volume of 9 g/L NaCl in MQ-water. Each sample was then concentrated 6 times using a using a Vivaspin 20 centrifugal concentrator with a 10,000 MWCO PES membrane (Sartorius Stedim Biotech GmbH, 37070 Goettingen, Germany). Protein concentration was determined using SDS-PAGE analysis.

Example 22: Measurement of Soluble and Insoluble Dietary Fiber in the Substrate Defatted De-Starched Maize (DFDSM) and Correlation to Soluble Xylose Measured after Enzymatic Incubation 400 mg of defatted de-starched maize (DFDSM) was added to NaOAc-buffer (5 mL, pH 5). The mixture was heated to between 90-100° C., then Termamyl 300 DX (100 μL, Novozymes A/S, Bagsvaerd, Denmark) was added and the mixture was incubated for 1 hr. The mixture was then cooled and amyloglucosidase from *Aspergillus niger* (500 μL, catalogue number E-AMGDF, for use in Megazyme Total Starch and Dietary Fiber, Megazyme International Ireland, Wicklow, Ireland) was added and samples were incubated overnight (16 h) at 60° C. The mixture was then cooled and centrifuged at 2500×g for 10 min at 5° C. The supernatant was collected and NaOAc-buffer (5 mL, pH 5) was added to the residue and centrifuged at 2500×g, 10 min, 5° C. This procedure was repeated twice. The supernatants were then collected, pooled and analysed for soluble NSP as described in A. The residue was analysed for insoluble NSP as described in B.

A: Soluble NSP, Supernatant

The pooled supernatants were diluted to a fixed volume from which a 5 mL aliquot of supernatant was taken. To this aliquot was added 20.1 mL cold 99.9% ethanol and the mixture was kept on ice for approx. 15 min for precipitation of polymers with a DP>10. After centrifuging at 2500×g, 5° C. for 10 min, the supernatant was discarded.

5 mL cold 80% ethanol was added to the pellet and the mixture was kept on ice for approx. 15 min. After centrifuging at 2500×g, 5° C. for 10 min, the supernatant was discarded.

Acid hydrolysis of the precipitate was conducted by the addition of MQ water (7.9 mL), myoinositol (0.5 mL, internal standard) and 12M $H_2SO_4$ (0.3 mL) and autoclaving at 125° C. for 55 minutes.

B: Insoluble NSP, Residue

The pellet obtained after AMG treatment was hydrolysed by the addition of MQ water (74 mL), myoinositol (10 mL, internal standard) and 12M $H_2SO_4$ (3 mL) and autoclaving at 125° C. for 55 minutes.

C. GLC Analysis

After autoclaving, the samples were reduced with borohydride to produce alditol sugars and these were derivatised by acetylation to become volatile for GLC analyses on an instrument with FID detector (Pettersson et al, (1995) "Total dietary fiber determined as neutral sugar residues, uronic acid residues, and Klason lignin (the Uppsala method), Collaborative study", *J. AOAC Int* 78:1030-1044). The concentration of the soluble or insoluble sugars was determined relative to myo-inositiol.

Example 23: Calculation of Percentage Solubilised Xylose

When DFDSM is incubated with enzyme at 40° C. for 4 hours, the enzyme solubilizes the xylan in the substrate and this solubilized xylan is then hydrolysed further by acid. The xylose released is measured spectrophotometrically using a D-xylose assay kit (Megazyme, catalogue number K-xylose). This xylose (which is actually enzyme solubilized xylan) is then correlated to the amount of total xylose of the substrate measured by GLC as described in part C of example 22.

The DFDSM contains 99% insoluble and 1% soluble xylose, in total 14.81% xylose which represents the concentration of xylose polymer (DP>10) present in the sample (DFDSM) according to the analysis. Based on the release of xylose measured by the Megazyme kit which calculates release based on sample weight, the amount of xylose released can be calculated as follows: e.g. 1% release from 400 mg of sample equals 4 mg of xylose. In 400 mg sample there is 400 mg×14.81% xylose, equal to 59.22 mg xylose. The gross xylose (insoluble+soluble) release is that case 4 mg/59.22 mg which represents a release of 6.75% of total xylose polymers, but it should be noted that this value must be corrected for the passive release obtained for the non-enzyme supplemented control. This corrected value is defined herein as the percentage solubilised xylose.

Example 24: Hydrolysis of Defatted Destarched Maize (DFDSM) Using a Combination of a GH10 or 11 Xylanase and GH43 and/or GH51 Arabinofuranosidases Defatted destarched maize (DFDSM, 400 mg) was added to aqueous sodium acetate (0.1 M, 3.9 mL) solution containing calcium chloride (5 mM) at pH 5 and the mixture heated to 40° C. for 30 minutes. 1004 buffer or enzyme solution was added and the sample was heated at 40° C. for 4 hours. The sample was cooled to 5° C. and centrifuged (4000 rpm, 5° C.) for 10 minutes. 1.7 mL of the sample was transferred to an Eppendorf tube and the enzyme deactivated by heating to 95° C. for 10 minutes. The samples were then frozen until hydrolysed (within 72 hours and xylose determination was performed immediately after hydrolysis).

The supernatant was thawed and centrifuged (14000 rpm) for 5 minutes. The supernatant (2504) was diluted with Milli-Q water (250 µL) in glass tubes and HCl (1.63 M, 2.0 mL) was added. The reaction was heated to 100° C. for 1 hour then cooled in an ice bath. Aqueous NaOH solution (1.3 M, 2.5 mL) was added whilst the samples were cooled on ice and the samples were stored at 0-5° C. whilst xylose content was analysed using the xylose assay. The results are presented in tables 2, 3 and 4.

TABLE 2

Xylose release from DFDSM using a GH10 or 11 xylanase or a GH43, GH51 or GH62 arabinofuranosidase

| GH10 or GH11 Xylanase | Conc. [mg EP/kg] | Arabinofuranosidase | Conc. [mg EP/kg] | Soluble xylose (%) | Percent solubilised xylose[1] |
|---|---|---|---|---|---|
| None | — | None | — | 0 | 0 |
| Ronozyme WX | 200 ppm | None | — | 0.04 | 0.1 |
| SEQ ID NO: 70 | 10 | None | — | 0.13 | 0.7 |
| None | — | SEQ ID NO: 93 | 10 | 0.03 | 0.0 |
| None | — | SEQ ID NO: 94 | 10 | 0.02 | 0.0 |
| None | — | SEQ ID NO: 24 | 10 | 0.07 | 0.3 |

Table 2 shows the amount of xylose measured after acid hydrolysis of supernatants (% of dry matter and % solubilized xylose of total xylose) when incubating DFDSM with either a xylanase (Ronozyme WX, a GH11 xylanase from *Thermomyces lanuginosus* or the GH10 xylanase of SEQ ID NO: 70), the GH43 arabinofuranosidase from *Humicola insolens* as disclosed as SEQ ID NO: 1 in WO2006/114095 (SEQ ID NO: 93 herein), the GH51 arabinofuranosidase from *Meripilus giganteus* as disclosed as SEQ ID NO: 2 in WO2006/114095 (SEQ ID NO: 94 herein) or a GH62 arabinofuranosidase of the invention (SEQ ID NO: 24).

[1]Percentage solubilised xylose was calculated as described in example 23.

TABLE 3

Xylose release from DFDSM using a GH10 xylanase and a GH43, GH51 or GH62 arabinofuranosidase

| GH10 Xylanase | Conc. [mg EP/kg] | Arabinofuranosidase | Conc. [mg EP/kg] | Soluble xylose (%) | Percent solubilised xylose[1] |
|---|---|---|---|---|---|
| None | — | None | — | 0 | 0 |
| SEQ ID NO: 70 | 10 | None | — | 0.15 | 0.8 |
| SEQ ID NO: 70 | 10 | SEQ ID NO: 93 | — | 0.18 | 1.1 |
| SEQ ID NO: 70 | 10 | SEQ ID NO: 94 | 10 | 0.18 | 1.1 |
| SEQ ID NO: 70 | 10 | SEQ ID NO: 93 + SEQ ID NO: 94 | 10 + 10 | 0.21 | 1.3 |
| SEQ ID NO: 70 | 10 | SEQ ID NO: 24 | 10 | 0.55 | 3.5 |

Table 3 shows the amount of xylose measured after acid hydrolysis of supernatants (% of dry matter and % solubilized xylose of total xylose) when incubating DFDSM with the GH10 xylanase of SEQ ID NO: 70 alone or in combination with the GH43 arabinofuranosidase from *Humicola insolens* as disclosed as SEQ ID NO: 1 in WO2006/114095 (SEQ ID NO: 93 herein), the GH51 arabinofuranosidase from *Meripilus giganteus* as disclosed as SEQ ID NO: 2 in WO2006/114095 (SEQ ID NO: 94 herein) or both the GH43 and GH51 arabinofuranosidases. For reference a GH62 arabinofuranosidase of the invention (SEQ ID NO: 24) was also tested with the GH10 xylanase of SEQ ID NO: 70.

[1]Percentage solubilised xylose was calculated as described in example 23.

TABLE 4

Xylose release from DFDSM using a GH11 xylanase and a GH43, GH51 or GH62 arabinofuranosidase

| GH11 Xylanase | Conc. [mg EP/kg] | Arabinofuranosidase | Conc. [mg EP/kg] | Soluble xylose (%) | Percent solubilised xylose[1] |
|---|---|---|---|---|---|
| None | — | None | — | 0 | 0.0 |
| Ronozyme WX | 200 ppm | None | — | 0.03 | 0.1 |
| Ronozyme WX | 200 ppm | SEQ ID NO: 93 | — | 0.03 | 0.1 |
| Ronozyme WX | 200 ppm | SEQ ID NO: 94 | 10 | 0.04 | 0.2 |
| Ronozyme WX | 200 ppm | SEQ ID NO: 93 + SEQ ID NO: 94 | 10 + 10 | 0.05 | 0.3 |
| Ronozyme WX | 200 ppm | SEQ ID NO: 24 | 10 | 0.52 | 3.4 |

Table 4 shows the amount of xylose measured after acid hydrolysis of supernatants (% of dry matter and % solubilized xylose of total xylose) when incubating DFDSM with Ronozyme WX (a GH11 xylanase from *Thermomyces lanuginosus*) alone or in combination with the GH43 arabinofuranosidase from *Humicola insolens* as disclosed as SEQ ID NO: 1 in WO2006/114095 (SEQ ID NO: 93 herein), the GH51 arabinofuranosidase from *Meripilus giganteus* as disclosed as SEQ ID NO: 2 in WO2006/114095 (SEQ ID NO: 94 herein) or both the GH43 and GH51 arabinofuranosidases. For reference a GH62 arabinofuranosidase of the invention (SEQ ID NO: 24) was also tested with Ronozyme WX.

[1]Percentage solubilised xylose was calculated as described in example 23.

Conclusion

The results show that the percent solubilised xylose is not significantly higher for the combination of a GH10 or GH11 xylanase and the prior art GH43 or GH51 arabinofuranosidases compared to the GH10 or GH11 xylanase alone. Further, the percent solubilised xylose for the combination of a GH10 or GH11 xylanase, the prior art GH43 arabinofuranosidases (which has activity towards di-substituted xyloses) and the prior art GH51 arabinofuranosidases (which has activity towards C2- or C3-position mono-substituted xyloses) is also not significantly higher compared to the GH10 or GH11 xylanase alone.

In comparison, the combination of a GH10 or GH11 xylanase and SEQ ID NO: 24 (a GH62 arabinofuranosidase) releases at least 4 times more percent solubilised xylose than the GH10 or GH11 xylanase alone.

Example 25: Hydrolysis of Defatted Destarched Maize (DFDSM) Using a Combination of a GH10 Xylanase and a GH62 Arabinofuranosidase Defatted destarched maize (DFDSM, 400 mg) was added to aqueous sodium acetate (0.1 M, 3.9 mL) solution containing calcium chloride (5 mM) at pH 5 and the mixture heated to 40° C. for 30 minutes. 1004 buffer or enzyme solution was added and the sample was heated at 40° C. for 4 hours. The sample was cooled to 5° C. and centrifuged (4000 rpm, 5° C.) for 10 minutes. 1.7 mL of the sample was transferred to an Eppendorf tube and the enzyme deactivated by heating to 95° C. for 10 minutes. The samples were then frozen until hydrolysed (within 72 hours and xylose determination was performed immediately after hydrolysis).

The supernatant was thawed and centrifuged (14000 rpm) for 5 minutes. The supernatant (250 µL) was diluted with Milli-Q water (250 µL) in glass tubes and HCl (1.63 M, 2.0 mL) was added. The reaction was heated to 100° C. for 1 hour then cooled in an ice bath. Aqueous NaOH solution (1.3 M, 2.5 mL) was added whilst the samples were cooled on ice and the samples were stored at 0-5° C. whilst xylose content was analysed using the xylose assay. The results are presented in tables 5, 6, 7, 8 and 9.

TABLE 5

Xylose release from DFDSM using a GH10 xylanase (SEQ ID NO: 72) and two different GH62 arabinofuranosidases (SEQ ID NO: 24 or 63)

| GH10 Xylanase | Conc. [mg EP/kg] | GH62 Arabinofuranosidase | Conc. [mg EP/kg] | Soluble xylose (%) | Percent solubilised xylose[1] |
|---|---|---|---|---|---|
| SEQ ID NO: 72 | 10 | None | — | 0.26 | 1.9 |
| SEQ ID NO: 72 | 10 | None | — | 0.26 | 1.9 |
| SEQ ID NO: 72 | 10 | None | — | 0.20 | 1.4 |
| SEQ ID NO: 72 | 10 | SEQ ID NO: 24 | 10 | 0.90 | 6.1 |
| SEQ ID NO: 72 | 10 | SEQ ID NO: 63 | 10 | 0.84 | 5.9 |

Table 5 shows the amount of xylose measured after acid hydrolysis of supernatants (% of dry matter and % solubilized xylose of total xylose) when incubating DFDSM with SEQ ID NO: 72 (a GH10 xylanase) alone or in combination with a GH62 arabinofuranosidase (SEQ ID NO: 24 or 63).
[1]Percentage solubilised xylose was calculated as described in example 23.

TABLE 6

Xylose release from DFDSM using a GH10 xylanase (SEQ ID NO: 72) and a GH62 arabinofuranosidase (SEQ ID NO: 24)

| GH10 Xylanase | Conc. [mg EP/kg] | GH62 Arabinofuranosidase | Conc. [mg EP/kg] | Soluble xylose (%) | Percent solubilised xylose[1] |
|---|---|---|---|---|---|
| SEQ ID NO: 72 | 10 | None | — | 0.29 | 1.9 |
| SEQ ID NO: 72 | 10 | SEQ ID NO: 24 | 10 | 1.22 | 8.2 |
| SEQ ID NO: 72 | 10 | SEQ ID NO: 24 | 10 | 1.20 | 8.0 |

Table 6 shows the amount of xylose measured after acid hydrolysis of supernatants (% of dry matter and % solubilized xylose of total xylose) when incubating DFDSM with SEQ ID NO: 72 (a GH10 xylanase) alone or in combination with a GH62 arabinofuranosidase (SEQ ID NO: 24).
[1]Percentage solubilised xylose was calculated as described in example 23.

TABLE 7

Xylose release from DFDSM using a GH10 xylanase (SEQ ID NO: 72) and a GH62 arabinofuranosidase (SEQ ID NO: 24)

| GH10 Xylanase | Conc. [mg EP/kg] | GH62 Arabinofuranosidase | Conc. [mg EP/kg] | Soluble xylose (%) | Percent solubilised xylose[1] |
|---|---|---|---|---|---|
| SEQ ID NO: 72 | 10 | None | — | 0.30 | 2.0 |
| SEQ ID NO: 72 | 10 | SEQ ID NO: 24 | 10 | 1.20 | 8.1 |

Table 7 shows the amount of xylose measured after acid hydrolysis of supernatants (% of dry matter and % solubilized xylose of total xylose) when incubating DFDSM with SEQ ID NO: 72 (a GH10 xylanase) alone or in combination with a GH62 arabinofuranosidase (SEQ ID NO: 24).
[1]Percentage solubilised xylose was calculated as described in example 23.

TABLE 8

Xylose release from DFDSM using a GH10 xylanase (SEQ ID NO: 70 or 72) and a GH62 arabinofuranosidases (SEQ ID NO: 9)

| GH10 Xylanase | Conc. [mg EP/kg] | GH62 Arabinofuranosidase | Conc. [mg EP/kg] | Soluble xylose (%) | Percent solubilised xylose[1] |
|---|---|---|---|---|---|
| SEQ ID NO: 70 | 25 | None | — | 0.16 | 1.1 |
| SEQ ID NO: 72 | 25 | None | — | 0.42 | 2.8 |
| None | — | SEQ ID NO: 9 | 12.5 | 0.02 | 0.2 |

TABLE 8-continued

Xylose release from DFDSM using a GH10 xylanase (SEQ ID NO: 70 or 72) and a GH62 arabinofuranosidases (SEQ ID NO: 9)

| GH10 Xylanase | Conc. [mg EP/kg] | GH62 Arabinofuranosidase | Conc. [mg EP/kg] | Soluble xylose (%) | Percent solubilised xylose[1] |
|---|---|---|---|---|---|
| SEQ ID NO: 70 | 25 | SEQ ID NO: 9 | 12.5 | 0.60 | 3.3 |
| SEQ ID NO: 72 | 25 | SEQ ID NO: 9 | 12.5 | 1.32 | 9.1 |

Table 8 shows the amount of xylose measured after acid hydrolysis of supernatants (% of dry matter and % solubilized xylose of total xylose) when incubating DFDSM with SEQ ID NO: 70 or 72 (a GH10 xylanase) alone or in combination with a GH62 arabinofuranosidase (SEQ ID NO: 9).
[1]Percentage solubilised xylose was calculated as described in example 23.

TABLE 9

Xylose release from DFDSM using a GH10 xylanase (SEQ ID NO: 71) and a GH62 arabinofuranosidases (SEQ ID NO: 21)

| GH10 Xylanase | Conc. [mg EP/kg] | GH62 Arabino-furanosidase | Conc. [mg EP/kg] | Soluble xylose (%) | Percent solubi-lised xylose[1] |
|---|---|---|---|---|---|
| SEQ ID NO: 71 | 10 | None | — | 0.54 | 3.5 |
| SEQ ID NO: 71 | 10 | None | — | 0.54 | 3.4 |
| SEQ ID NO: 71 | 10 | SEQ ID NO: 21 | 10 | 1.28 | 8.4 |

Table 9 shows the amount of xylose measured after acid hydrolysis of supernatants (% of dry matter and % solubilized xylose of total xylose) when incubating DFDSM with SEQ ID NO: 71 (a GH10 xylanase) alone or in combination with a GH62 arabinofuranosidase (SEQ ID NO: 21).
[1]Percentage solubilised xylose was calculated as described in example 23.

Conclusion

The results show that the percent solubilised xylose is significantly higher (at least 2 times) for all of the combinations of GH10 xylanase and GH62 arabinofuranosidase tested compared to the GH10 xylanase alone.

Example 26: Hydrolysis of Defatted Destarched Maize (DFDSM) Using a Combination of a GH11 Xylanase and a GH62 Arabinofuranosidase Defatted destarched maize (DFDSM, 400 mg) was added to aqueous sodium acetate (0.1 M, 3.9 mL) solution containing calcium chloride (5 mM) at pH 5 and the mixture heated to 40° C. for 30 minutes. 100␣ buffer or enzyme solution was added and the sample was heated at 40° C. for 4 hours. The sample was cooled to 5° C. and centrifuged (4000 rpm, 5° C.) for 10 minutes. 1.7 mL of the sample was transferred to an Eppendorf tube and the enzyme deactivated by heating to 95° C. for 10 minutes. The samples were then frozen until hydrolysed (within 72 hours and xylose determination was performed immediately after hydrolysis).

The supernatant was thawed and centrifuged (14000 rpm) for 5 minutes. The supernatant (250␣) was diluted with Milli-Q water (250 μL) in glass tubes and HCl (1.63 M, 2.0 mL) was added. The reaction was heated to 100° C. for 1 hour then cooled in an ice bath. Aqueous NaOH solution (1.3 M, 2.5 mL) was added whilst the samples were cooled on ice and the samples were stored at 0-5° C. whilst xylose content was analysed using the xylose assay. The results are presented in tables 10 to 18 inclusive.

TABLE 10

Xylose release from DFDSM using a GH11 xylanase (SEQ ID NO: 73) and two different GH62 arabinofuranosidases (SEQ ID NO: 9 or 12)

| GH11 Xylanase | Conc. [mg EP/kg] | GH62 Arabino-furanosidase | Conc. [mg EP/kg] | Soluble xylose (%) | Percent solubi-lised xylose[1] |
|---|---|---|---|---|---|
| SEQ ID NO: 73 | 25 | None | — | 0.09 | 0.5 |
| None | — | SEQ ID NO: 12 | 12.5 | 0.02 | 0.1 |
| None | — | SEQ ID NO: 9 | 12.5 | 0.04 | 0.1 |
| SEQ ID NO: 73 | 25 | SEQ ID NO: 12 | 12.5 | 0.58 | 3.8 |
| SEQ ID NO: 73 | 25 | SEQ ID NO: 9 | 12.5 | 0.52 | 3.4 |

Table 10 shows the amount of xylose measured after acid hydrolysis of supernatants (% of dry matter and % solubilized xylose of total xylose) when incubating DFDSM with SEQ ID NO: 73 (a GH11 xylanase) alone or in combination with a GH62 arabinofuranosidase (SEQ ID NO: 9 or 12).
[1]Percentage solubilised xylose was calculated as described in example 23.

TABLE 11

Xylose release from DFDSM using a GH11 xylanase (SEQ ID NO: 73) and four different GH62 arabinofuranosidases (SEQ ID NO: 9, 15, 18 or 21)

| GH11 Xylanase | Conc. [mg EP/kg] | GH62 Arabino-furanosidase | Conc. [mg EP/kg] | Soluble xylose (%) | Percent solubi-lised xylose[1] |
|---|---|---|---|---|---|
| SEQ ID NO: 73 | 25 | None | — | 0.08 | 0.1 |
| SEQ ID NO: 73 | 25 | SEQ ID NO: 15 | 12.5 | 0.43 | 2.9 |
| SEQ ID NO: 73 | 25 | SEQ ID NO: 18 | 12.5 | 0.48 | 3.3 |
| SEQ ID NO: 73 | 25 | SEQ ID NO: 21 | 12.5 | 0.58 | 4.0 |
| SEQ ID NO: 73 | 25 | SEQ ID NO: 9 | 12.5 | 0.56 | 3.9 |

Table 11 shows the amount of xylose measured after acid hydrolysis of supernatants (% of dry matter and % solubilized xylose of total xylose) when incubating DFDSM with SEQ ID NO: 73 (a GH11 xylanase) alone or in combination with a GH62 arabinofuranosidase (SEQ ID NO: 9, 15, 18 or 21).
[1]Percentage solubilised xylose was calculated as described in example 23.

TABLE 12

Xylose release from DFDSM using a GH11 xylanase (SEQ ID NO: 73, 75, 81 or 84) and two different GH62 arabinofuranosidases (SEQ ID NO: 9 or 12)

| GH11 Xylanase | Conc. [mg EP/kg] | GH62 Arabino-furanosidase | Conc. [mg EP/kg] | Soluble xylose (%) | Percent solubi-lised xylose[1] |
|---|---|---|---|---|---|
| SEQ ID NO: 73 | 25 | None | — | 0.07 | 0.3 |
| SEQ ID NO: 73 | 25 | None | — | 0.09 | 0.5 |
| SEQ ID NO: 75 | 25 | None | — | 0.21 | 1.3 |
| SEQ ID NO: 75 | 25 | None | — | 0.16 | 0.9 |
| SEQ ID NO: 81 | 25 | None | — | 0.32 | 2.1 |

TABLE 12-continued

Xylose release from DFDSM using a GH11 xylanase
(SEQ ID NO: 73, 75, 81 or 84) and two different
GH62 arabinofuranosidases (SEQ ID NO: 9 or 12)

| GH11 Xylanase | Conc. [mg EP/ kg] | GH62 Arabino- furanosidase | Conc. [mg EP/ kg] | Soluble xylose (%) | Percent solubi- lised xylose[1] |
|---|---|---|---|---|---|
| SEQ ID NO: 81 | 25 | None | — | 0.39 | 2.6 |
| SEQ ID NO: 87 | 25 | None | — | 0.31 | 2.0 |
| SEQ ID NO: 87 | 25 | None | — | 0.25 | 1.7 |
| None | — | SEQ ID NO: 9 | 12.5 | 0.07 | 0.3 |
| None | — | SEQ ID NO: 9 | 12.5 | 0.04 | 0.1 |
| None | — | SEQ ID NO: 9 | 12.5 | 0.02 | 0.1 |
| None | — | SEQ ID NO: 9 | 12.5 | 0.03 | 0.1 |
| None | — | SEQ ID NO: 12 | 12.5 | 0.02 | 0.0 |
| None | — | SEQ ID NO: 12 | 12.5 | 0.03 | 0.1 |
| None | — | SEQ ID NO: 12 | 12.5 | 0.02 | 0.1 |
| None | — | SEQ ID NO: 12 | 12.5 | 0.02 | 0.0 |
| SEQ ID NO: 73 | 25 | SEQ ID NO: 9 | 12.5 | 0.53 | 3.5 |
| SEQ ID NO: 73 | 25 | SEQ ID NO: 12 | 12.5 | 0.48 | 3.1 |
| SEQ ID NO: 75 | 25 | SEQ ID NO: 9 | 12.5 | 0.80 | 5.3 |
| SEQ ID NO: 75 | 25 | SEQ ID NO: 12 | 12.5 | 0.78 | 5.1 |
| SEQ ID NO: 81 | 25 | SEQ ID NO: 9 | 12.5 | 0.97 | 6.5 |
| SEQ ID NO: 81 | 25 | SEQ ID NO: 12 | 12.5 | 1.00 | 6.7 |
| SEQ ID NO: 87 | 25 | SEQ ID NO: 9 | 12.5 | 0.89 | 5.9 |
| SEQ ID NO: 87 | 25 | SEQ ID NO: 12 | 12.5 | 0.87 | 5.8 |

Table 12 shows the amount of xylose measured after acid hydrolysis of supernatants (% of dry matter and % solubilized xylose of total xylose) when incubating DFDSM with SEQ ID NO: 73, 75, 81 or 84 (a GH11 xylanase) alone or in combination with a GH62 arabinofuranosidase (SEQ ID NO: 9 or 12).
[1]Percentage solubilised xylose was calculated as described in example 23.

TABLE 13

Xylose release from DFDSM using a GH11 xylanase (SEQ ID NO: 74) and a GH62 arabinofuranosidases (SEQ ID NO: 9)

| GH11 Xylanase | Conc. [mg EP/ kg] | GH62 Arabino- furanosidase | Conc. [mg EP/ kg] | Soluble xylose (%) | Percent solubi- lised xylose[1] |
|---|---|---|---|---|---|
| SEQ ID NO: 74 | 25 | None | — | 0.17 | 1.2 |
| None | — | SEQ ID NO: 9 | 12.5 | 0.02 | 0.2 |
| SEQ ID NO: 74 | 25 | SEQ ID NO: 9 | 12.5 | 0.75 | 5.1 |

Table 13 shows the amount of xylose measured after acid hydrolysis of supernatants (% of dry matter and % solubilized xylose of total xylose) when incubating DFDSM with SEQ ID NO: 74 (a GH11 xylanase) alone or in combination with a GH62 arabinofuranosidase (SEQ ID NO: 9).
[1]Percentage solubilised xylose was calculated as described in example 23.

TABLE 14

Xylose release from DFDSM using a GH11 xylanase
(SEQ ID NO: 78) and three different GH62 arabinofuranosidases
(SEQ ID NO: 51, 57 or 69)

| GH11 Xylanase | Conc. [mg EP/ kg] | GH62 Arabino- furanosidase | Conc. [mg EP/ kg] | Soluble xylose (%) | Percent solubi- lised xylose[1] |
|---|---|---|---|---|---|
| SEQ ID NO: 78 | 10 | None | — | 0.33 | 2.3 |
| SEQ ID NO: 78 | 10 | SEQ ID NO: 51 | 10 | 0.96 | 6.5 |
| SEQ ID NO: 78 | 10 | SEQ ID NO: 57 | 10 | 1.13 | 7.6 |
| SEQ ID NO: 78 | 10 | SEQ ID NO: 69 | 10 | 1.17 | 7.9 |

Table 14 shows the amount of xylose measured after acid hydrolysis of supernatants (% of dry matter and % solubilized xylose of total xylose) when incubating DFDSM with SEQ ID NO: 78 (a GH11 xylanase) alone or in combination with a GH62 arabinofuranosidase (SEQ ID NO: 51, 57 or 69).
[1]Percentage solubilised xylose was calculated as described in example 23.

TABLE 15

Xylose release from DFDSM using a GH11 xylanase
(SEQ ID NO: 78) and three different GH62 arabinofuranosidases
(SEQ ID NO: 27, 45 or 63)

| GH11 Xylanase | Conc. [mg EP/ kg] | GH62 Arabino- furanosidase | Conc. [mg EP/ kg] | Soluble xylose (%) | Percent solubi- lised xylose[1] |
|---|---|---|---|---|---|
| SEQ ID NO: 78 | 10 | None | — | 0.36 | 2.4 |
| SEQ ID NO: 78 | 10 | None | — | 0.31 | 2.0 |
| SEQ ID NO: 78 | 10 | SEQ ID NO: 27 | 10 | 1.31 | 8.1 |
| SEQ ID NO: 78 | 10 | SEQ ID NO: 45 | 10 | 0.94 | 6.2 |
| SEQ ID NO: 78 | 10 | SEQ ID NO: 63 | 10 | 0.99 | 6.6 |

Table 15 shows the amount of xylose measured after acid hydrolysis of supernatants (% of dry matter and % solubilized xylose of total xylose) when incubating DFDSM with SEQ ID NO: 78 (a GH11 xylanase) alone or in combination with a GH62 arabinofuranosidase (SEQ ID NO: 27, 45 or 63).
[1]Percentage solubilised xylose was calculated as described in example 23.

TABLE 16

Xylose release from DFDSM using a GH11 xylanase (SEQ ID NO: 73 or 78) and a GH62 arabinofuranosidases (SEQ ID NO: 21)

| GH11 Xylanase | Conc. [mg EP/ kg] | GH62 Arabino- furanosidase | Conc. [mg EP/ kg] | Soluble xylose (%) | Percent solubi- lised xylose[1] |
|---|---|---|---|---|---|
| SEQ ID NO: 73 | 25 | None | — | 0.10 | 0.5 |
| SEQ ID NO: 78 | 10 | None | — | 0.33 | 2.1 |
| SEQ ID NO: 73 | 25 | SEQ ID NO: 21 | 10 | 0.58 | 3.7 |
| SEQ ID NO: 78 | 10 | SEQ ID NO: 21 | 10 | 1.03 | 6.8 |

Table 16 shows the amount of xylose measured after acid hydrolysis of supernatants (% of dry matter and % solubilized xylose of total xylose) when incubating DFDSM with SEQ ID NO: 78 (a GH11 xylanase) alone or in combination with a GH62 arabinofuranosidase (SEQ ID NO: 27, 45 or 63).
[1]Percentage solubilised xylose was calculated as described in example 23.

TABLE 17

Xylose release from DFDSM using a GH11 xylanase
(SEQ ID NO: 88) and four different GH62 arabinofuranosidases
(SEQ ID NO: 9, 12, 24 or 27)

| GH11 Xylanase | Conc. [mg EP/ kg] | GH62 Arabino- furanosidase | Conc. [mg EP/ kg] | Soluble xylose (%) | Percent solubi- lised xylose[1] |
|---|---|---|---|---|---|
| None | — | None | — | 0 | 0 |
| SEQ ID NO: 88 | 10 | None | — | 0.09 | 0.5 |
| SEQ ID NO: 88 | 10 | SEQ ID NO: 27 | 10 | 0.65 | 4.4 |
| SEQ ID NO: 88 | 10 | SEQ ID NO: 24 | 10 | 1.22 | 8.2 |
| SEQ ID NO: 88 | 10 | SEQ ID NO: 9 | 10 | 0.57 | 3.8 |
| SEQ ID NO: 88 | 10 | SEQ ID NO: 12 | 10 | 0.50 | 3.3 |

Table 17 shows the amount of xylose measured after acid hydrolysis of supernatants (% of dry matter and % solubilized xylose of total xylose) when incubating DFDSM with SEQ ID NO: 88 (a GH11 xylanase) alone or in combination with a GH62 arabinofuranosidase (SEQ ID NO: 9, 12, 24 or 27).
[1]Percentage solubilised xylose was calculated as described in example 23.

TABLE 18

Xylose release from DFDSM using a GH11 xylanase
(SEQ ID NO: 89) and four different GH62 arabinofuranosidases
(SEQ ID NO: 9, 12, 24 or 27)

| GH11 Xylanase | Conc. [mg EP/ kg] | GH62 Arabino- furanosidase | Conc. [mg EP/ kg] | Soluble xylose (%) | Percent solubi- lised xylose[1] |
|---|---|---|---|---|---|
| None | — | None | — | 0 | 0 |
| SEQ ID NO: 89 | 10 | None | — | 0.07 | 0.5 |

TABLE 18-continued

Xylose release from DFDSM using a GH11 xylanase
(SEQ ID NO: 89) and four different GH62 arabinofuranosidases
(SEQ ID NO: 9, 12, 24 or 27)

| GH11 Xylanase | Conc. [mg EP/ kg] | GH62 Arabino- furanosidase | Conc. [mg EP/ kg] | Soluble xylose (%) | Percent solubi- lised xylose[1] |
|---|---|---|---|---|---|
| SEQ ID NO: 89 | 10 | SEQ ID NO: 27 | 10 | 0.36 | 2.4 |
| SEQ ID NO: 89 | 10 | SEQ ID NO: 24 | 10 | 0.76 | 5.1 |
| SEQ ID NO: 89 | 10 | SEQ ID NO: 9 | 10 | 0.43 | 2.9 |
| SEQ ID NO: 89 | 10 | SEQ ID NO: 12 | 10 | 0.35 | 2.3 |

Table 18 shows the amount of xylose measured after acid hydrolysis of supernatants (% of dry matter and % solubilized xylose of total xylose) when incubating DFDSM with SEQ ID NO: 89 (a GH11 xylanase) alone or in combination with a GH62 arabinofuranosidase (SEQ ID NO: 9, 12, 24 or 27).
[1]Percentage solubilised xylose was calculated as described in example 23.

Conclusion

The results show that the percent solubilised xylose is significantly higher (at least 2 times) for all of the combinations of GH11 xylanase and GH62 arabinofuranosidase tested compared to the GH11 xylanase alone.

Example 27: Hydrolysis of Defatted Destarched Maize (DFDSM) Using a Combination of a Commercial Animal Feed Xylanase and a GH62 Arabinofuranosidase Defatted destarched maize (DFDSM, 400 mg) was added to aqueous sodium acetate (0.1 M, 3.9 mL) solution containing calcium chloride (5 mM) at pH 5 and the mixture heated to 40° C. for 30 minutes. 10 µL buffer or enzyme solution was added and the sample was heated at 40° C. for 4 hours. The sample was cooled to 5° C. and centrifuged (4000 rpm, 5° C.) for 10 minutes. 1.7 mL of the sample was transferred to an Eppendorf tube and the enzyme deactivated by heating to 95° C. for 10 minutes. The samples were then frozen until hydrolysed (within 72 hours and xylose determination was performed immediately after hydrolysis).

The supernatant was thawed and centrifuged (14000 rpm) for 5 minutes. The supernatant (250 µL) was diluted with Milli-Q water (250 µL) in glass tubes and HCl (1.63 M, 2.0 mL) was added. The reaction was heated to 100° C. for 1 hour then cooled in an ice bath. Aqueous NaOH solution (1.3 M, 2.5 mL) was added whilst the samples were cooled on ice and the samples were stored at 0-5° C. whilst xylose content was analysed using the xylose assay. The results are presented in tables 19, 20 and 21

TABLE 19

Xylose release from DFDSM using Rovabio Excel and four different
GH62 arabinofuranosidases (SEQ ID NO: 9, 12, 24 or 27)

| Xylanase | Conc. [ppm] | Arabino- furanosidase | Conc. [mg EP/ kg] | Soluble xylose (%) | Percent solubi- lised xylose[1] |
|---|---|---|---|---|---|
| Rovabio Excel AP | 50 ppm | None | — | 0.01 | 0.1 |
| Rovabio Excel AP | 50 ppm | SEQ ID NO: 27 | 10 | 0.07 | 0.5 |
| Rovabio Excel AP | 50 ppm | SEQ ID NO: 24 | 10 | 0.13 | 0.9 |
| Rovabio Excel AP | 50 ppm | SEQ ID NO: 9 | 10 | 0.08 | 0.5 |
| Rovabio Excel AP | 50 ppm | SEQ ID NO: 12 | 10 | 0.06 | 0.4 |

Table 19 shows the amount of xylose measured after acid hydrolysis of supernatants (% of dry matter and % solubilized xylose of total xylose) when incubating DFDSM with Rovabio Excel AP alone or in combination with a GH62 arabinofuranosidase (SEQ ID NO: 9, 12, 24 or 27). Rovabio Excel AP is available from Adisseo and the product declaration states that it has xylanase activity and endo-1,3(4)-beta-glucanase activity.
[1]Percentage solubilised xylose was calculated as described in example 23.

TABLE 20

Xylose release from DFDSM using Econase XT and four different
GH62 arabinofuranosidases (SEQ ID NO: 9, 12, 24 or 27)

| Xylanase | Conc. [ppm] | Arabino- furanosidase | Conc. [mg EP/ kg] | Soluble xylose (%) | Percent solubi- lised xylose[1] |
|---|---|---|---|---|---|
| Econase XT 25 | 150 ppm | None | — | 0.04 | 0.1 |
| Econase XT 25 | 150 ppm | SEQ ID NO: 27 | 10 | 0.20 | 1.2 |
| Econase XT 25 | 150 ppm | SEQ ID NO: 24 | 10 | 0.46 | 3.0 |
| Econase XT 25 | 150 ppm | SEQ ID NO: 9 | 10 | 0.18 | 1.1 |
| Econase XT 25 | 150 ppm | SEQ ID NO: 12 | 10 | 0.14 | 0.8 |

Table 20 shows the amount of xylose measured after acid hydrolysis of supernatants (% of dry matter and % solubilized xylose of total xylose) when incubating DFDSM with Econase XT 25 alone or in combination with a GH62 arabinofuranosidase (SEQ ID NO: 9, 12, 24 or 27). Econase XT 25 is available from AB Enzymes and the product declaration states that it has endo-1,4-beta-xylanase activity.
[1]Percentage solubilised xylose was calculated as described in example 23.

TABLE 21

Xylose release from DFDSM using Belfeed and four different
GH62 arabinofuranosidases (SEQ ID NO: 9, 12, 24 or 27)

| Xylanase | Conc. [ppm] | Arabino- furanosidase | Conc. [mg EP/ kg] | Soluble xylose (%) | Percent solubi- lised xylose[1] |
|---|---|---|---|---|---|
| Belfeed B 1100 MP | 100 ppm | None | — | 0.04 | 0.2 |
| Belfeed B 1100 MP | 100 ppm | SEQ ID NO: 27 | 10 | 0.21 | 1.3 |
| Belfeed B 1100 MP | 100 ppm | SEQ ID NO: 24 | 10 | 0.38 | 2.5 |
| Belfeed B 1100 MP | 100 ppm | SEQ ID NO: 9 | 10 | 0.21 | 1.3 |
| Belfeed B 1100 MP | 100 ppm | SEQ ID NO: 12 | 10 | 0.18 | 1.1 |

Table 21 shows the amount of xylose measured after acid hydrolysis of supernatants (% of dry matter and % solubilized xylose of total xylose) when incubating DFDSM with Belfeed B 1100 MP alone or in combination with a GH62 arabinofuranosidase (SEQ ID NO: 9, 12, 24 or 27). Belfeed B 1100 MP is available from Beldem and the product declaration states that it has specific pentosanase endo-1,4-beta-xylanase (EC 3.2.1.8) activity.
[1]Percentage solubilised xylose was calculated as described in example 23.

Conclusion

The results show that the percent solubilised xylose is significantly higher (at least 2 times) for all of the combinations of the commercially available xylanases and GH62 arabinofuranosidase tested compared to the commercially available xylanase alone.

Example 28: Cloning of GH11 Xylanase from *Lasiodiplodia theobromae* (SEQ ID NO: 99)

The xylanase with nucleotide sequence SEQ ID NO: 97 was PCR amplified from genomic DNA isolated from *Lasiodiplodia theobromae* and cloned into the expression vector pSUN515, which is a derivative of pCaHj505 (WO2013029496).

The final expression plasmid was transformed into the *Aspergillus oryzae* MT3568 expression host. *A. oryzae* MT3568 is a derivative of *A. oryzae* JaL355 (WO02/40694) in which pyrG auxotrophy was restored by disrupting the *A. oryzae* acetamidase (amdS) gene with the pyrG gene. The xylanase gene was integrated by homologous recombination into the *A. oryzae* MT3568 host cell genome upon transformation.

The gene coding for amdS was used as marker. Transformants were selected on pyrG media agar supplemented with 10 mM acetamide. One recombinant *Aspergillus oryzae* clone containing the xylanase expression construct was selected and was cultivated on a rotary shaking table in 4 2-liter baffled Erlenmeyer flasks each containing 400 ml YPM (1% Yeast extract, 2% Peptone and 2% Maltose). After 3 days cultivation time at 30° C., enzyme containing supernatants were harvested by filtration using a 0.22 μm 1-liter bottle top vacuum filter (Corning Inc., Corning, N.Y., USA).

Example 29: Purification of GH11 Xylanase from *Lasiodiplodia theobromae* (SEQ ID NO: 99)

A 1600 ml volume of filtered supernatant of *Aspergillus oryzae* (example 32) was precipitated with ammonium sulfate (80% saturation), re-dissolved in 50 ml of 20 mM Tris-HCl pH 7.5, dialyzed against the same buffer, and filtered through a 0.45 μm filter. The final volume was 75 ml. The solution was applied to a 40 ml Q SEPHAROSE® Fast Flow column (GE Healthcare, Buckinghamshire, UK) equilibrated with 20 mM Tris-HCl pH 7.5. Proteins were eluted with a linear 0-0.25 M NaCl gradient. Fractions were analyzed by SDS-PAGE using a NUPAGE® NOVEX® 4-12% Bis-Tris Gel with 50 mM MES. The resulting gel was stained with INSTANTBLUE™. Fractions containing a band at approximately 22 kDa were pooled. Then the pooled solution was concentrated by ultrafiltration.

Example 30: Cloning of a GH10 Xylanase from *Ascobolus stictoideus* (SEQ ID NO: 102)

The xylanase with nucleotide sequence SEQ ID NO: 100 and the peptide translation of the protein shown in SEQ ID NO: 101 was PCR amplified from genomic DNA isolated from *Ascobolus stictoideus* and cloned into the expression vector pDAu222 as described in WO 2013024021 using BamHI and XhoI restriction sites.

The sequence of the xylanase encoding gene cloned in the expression vector was confirmed and the expression construct was transformed into the *Aspergillus oryzae* strain MT3568 (WO 11/057140) to produce the secreted mature peptide with protein sequence SEQ ID NO: 102. Transformants were selected on acetamide during regeneration from protoplasts and subsequently re-isolated under selection (Christensen et al., 1988, *Biotechnology* 6, 1419-1422 and WO 04/032648).

For production of the recombinant xylanase, a single *Aspergillus* transformant was cultured in six 500 ml baffled flasks each containing 180 ml of DAP-4C-1 medium (WO 12/103350). The cultures were shaken on a rotary table at 150 RPM at 26° C. for 3 days. The culture broth subsequently was separated from cellular material by passage through a 0.22 um filter.

Example 31: Purification of the GH10 Xylanase from *Ascobolus stictoideus* (SEQ ID NO: 102)

The filtered broth was buffer exchanged with HEPES (50 mM, pH 7) using a QuixStand Tangential flow ultrafiltration system fitted with a 10 KDa cut-off cartridge (GE Healthcare, QuixStand Product code: QSM-02SP/50; 10 KDa Cartridge Product code: UFP-10E-4MA). The buffer exchanged sample was loaded onto a column packed with UNOsphereTMQ (Bio-Rad Laboratories, Hercules, Calif.; Catalogue No: 156-0105) which was equilibrated with the same buffer as that used for the buffer exchange of the sample. After wash with equilibration buffer, bound protein was eluted with step-wise increase of NaCl concentration in following order: 50 mM, 100 mM, 200 mM, 500 mM and 1000 mM. All the fractions including flow through and wash were collected and analyzed by SDS-PAGE. On analysis, it was observed that the purified sample was in the flow through. The flow through was concentrated using the same Ultrafiltration system as mention above. The quantity of the purified sample was determined spectrometrically (A280) and analyzed using SDS-PAGE.

Example 32: Cloning of GH62 Arabinofuranosidases from *Penicillium soppii*, *Aspergillus aculeatus*, *Aspergillus fumigatiaffinis*, *Neosartorya fischeri*, *Thielavia arenaria*, *Thielavia terricola*, *Chaetomium olivicolor*, *Curvularia geniculata*, *Drechslera* sp., and *Humicola* sp. (SEQ ID NO: 105, 123, 138, 147, 156, 159, 162, 165, 168, 171 and 174)

The arabinofuranosidase encoding genes with the nucleotide sequences SEQ ID NO: 145, 136, 154, 157, 160, 169, 166, 163, 121, 103 and 172 were PCR amplified from genomic DNA isolated from *Penicillium soppii*, *Aspergillus aculeatus*, *Aspergillus fumigatiaffinis*, *Neosartorya fischeri*, *Thielavia arenaria*, *Thielavia terricola*, *Chaetomium olivicolor*, *Curvularia geniculata*, *Drechslera* sp., and *Humicola* sp. and cloned into the *Aspergillus* expression vector pMStr57 (WO 04/032648).

The sequences of the arabinofuranosidase encoding genes cloned in the expression vector were confirmed, and the expression constructs were transformed into the *Aspergillus oryzae* strain MT3568 (WO 11/057140). Transformants were selected on acetamide during regeneration from protoplasts and subsequently re-isolated under selection (Christensen et al., 1988, *Biotechnology* 6, 1419-1422 and WO 04/032648).

For production of the recombinant arabinofuranosidases, a single *Aspergillus* transformant was selected for each arabinofuranosidase and the transformants were cultured in 500 ml baffled flasks containing 150 ml of DAP-4C-1 medium (WO 12/103350). The cultures were shaken on a rotary table at 150 RPM at 30° C. for 4 days. The culture broth was subsequently separated from cellular material by passage through a 0.22 um filter.

Example 33: Purification of GH62 Arabinofuranosidases from *Penicillium Aspergillus aculeatus, Aspergillus fumigatiaffinis, Neosartorya fischeri, Thielavia arenaria, Thielavia terricola, Chaetomium olivicolor, Curvularia geniculata, Drechslera* sp., and *Humicola* sp. (SEQ ID NO: 105, 123, 138, 147, 156, 159, 162, 165, 168, 171 and 174)

The filtrated sample was adjusted to around pH 7.5 and 1.8M ammonium sulfate was added. The sample was applied to a 5 ml HiTrap™ Phenyl (HS) column on an Akta Explorer. Prior to loading, the column had been equilibrated in 5 column volumes (CV) of 50 mM HEPES+1.8M AMS pH 7. In order to remove unbound material, the column was washed with 5 CV of 50 mM HEPES+1.8M AMS pH 7. The target protein was eluted from the column into a 10 ml loop using 50 mM HEPES+20% isopropanol pH 7. From the loop, the sample was loaded onto a desalting column (HiPrep™ 26/10 Desalting), which had been equilibrated with 3 CV of 50 mM HEPES+100 mM NaCl pH 7.0. The target protein was eluted with 50 mM HEPES+100 mM NaCl pH 7.0 and relevant fractions were selected and pooled based on the chromatogram. The flow rate was 5 ml/min.

Example 34: Cloning of GH62 Arabinofuranosidases from *Xylanibacterium* sp-61981 and *Glycomyces rutgersensis* (SEQ ID NO: 111 and 129)

The bacterial GH62 sequences from *Xylanibacterium* sp-61981 (SEQ ID NO: 106) and *Glycomyces rutgersensis* (SEQ ID NO: 124) were cloned into a *Bacillus* expression vector as described in example 8 to give the His-tag sequence operably linked to the mature wild type AraF sequence and *Bacillus clausii* secretion signal as shown in SEQ ID NO: 109 and SEQ ID NO: 127 respectively. The gene construct was then expressed as described in example 8.

Example 35: Purification of GH62 Arabinofuranosidases from *Xylanibacterium* sp-61981 and *Glycomyces rutgersensis* (SEQ ID NO: 111 and 129)

pH was adjusted to pH 8, filtrated through a 0.2 µM, and the supernatant applied to a 5 ml HisTrap™ excel column. Prior to loading, the column had been equilibrated in 5 column volumes (CV) of 50 mM Tris/HCl pH 8. In order to remove unbound material, the column was washed with 8 CV of 50 mM Tris/HCl pH 8, and elution of the target was obtained with 50 mM HEPES pH 7+10 mM imidazole. The eluted protein was desalted on a HiPrep™ 26/10 desalting column, equilibrated using 3 CV of 50 mM HEPES pH 7+100 mM NaCl. This buffer was also used for elution of the target, and the flow rate was 10 ml/min. Relevant fractions were selected and pooled based on the chromatogram and SDS-PAGE analysis.

Example 36: Cloning of a GH62 Arabinofuranosidase from *Microdochium nivale* (SEQ ID NO: 117)

An arabinofuranosidase encoding gene with the nucleotide sequence SEQ ID NO: 112 was PCR amplified from genomic DNA isolated from *Microdochium nivale* and cloned into the *Aspergillus* expression vector pMStr366. The vector pMStr366 is a version of the expression vector pMStr57 (WO 04/032648) that has been modified to allow fusion of an insert CDS to a vector-encoded HIS tag with the sequence RHHHHHHP (SEQ ID NO: 91). The nucleotide sequence of the resulting fusion is shown in SEQ ID NO: 115 and the peptide translation of the His-tagged protein is shown in SEQ ID NO: 116.

The sequence of the tagged arabinofuranosidase encoding gene cloned in the expression vector was confirmed, and the expression construct was transformed into the *Aspergillus oryzae* strain MT3568 (WO 11/057140). Transformants were selected on acetamide during regeneration from protoplasts and subsequently re-isolated under selection (Christensen et al., 1988, *Biotechnology* 6, 1419-1422 and WO 04/032648).

For production of the recombinant arabinofuranosidase, a single *Aspergillus* transformant was selected, and the transformant was cultured in 500 ml baffled flasks containing 100 ml of YPG medium (WO 05/066338). The cultures were shaken on a rotary table at 150 RPM at 30° C. for 4 days. The culture broth was subsequently separated from cellular material by passage through a 0.22 um filter.

Example 37: Cloning of a GH62 Arabinofuranosidase from *Microdochium nivale* (SEQ ID NO: 117)

The GH62 arabinofuranosidases were purified as described in example 35.

Example 38: Cloning of a GH62 Arabinofuranosidase from *Humicola hyalothermophila* (SEQ ID NO: 120)

The arabinofuranosidase with nucleotide sequence SEQ ID NO: 118 was PCR amplified from genomic DNA isolated from *Humicola hyalothermophila* and cloned into the expression vector pSUN515, which is a derivative of pCaHj505 (WO2013029496).

The final expression plasmid was transformed into the *Aspergillus oryzae* MT3568 expression host. *A. oryzae* MT3568 is a derivative of *A. oryzae* JaL355 (WO02/40694) in which pyrG auxotrophy was restored by disrupting the *A. oryzae* acetamidase (amdS) gene with the pyrG gene. The arabinofuranosidase gene was integrated by homologous recombination into the *A. oryzae* MT3568 host cell genome upon transformation.

The gene coding for amdS was used as marker. Transformants were selected on pyrG media agar supplemented with 10 mM acetamide. One recombinant *Aspergillus oryzae* clone containing the arabinofuranosidase expression construct was selected and was cultivated on a rotary shaking table in 4 2-liter baffled Erlenmeyer flasks each containing 400 ml YPM (1% Yeast extract, 2% Peptone and 2% Maltose). After 3 days cultivation time at 30° C., enzyme containing supernatants were harvested by filtration using a 0.22 µm 1-liter bottle top vacuum filter (Corning Inc., Corning, N.Y., USA).

Example 39: Purification of the GH62 Arabinofuranosidase from *Humicola hyalothermophila* (SEQ ID NO: 120)

A 1400 ml volume of filtered supernatant was precipitated with ammonium sulfate (80% saturation), re-dissolved in 50 ml of 20 mM Bis-Tris pH 6.0, dialyzed against the same buffer, and filtered through a 0.45 µm filter. The final volume was 80 ml. The solution was applied to a 50 ml Q SEPHAROSE® Fast Flow column (GE Healthcare, Buckinghamshire, UK) equilibrated with 20 mM Bis-Tris pH 6.0. Proteins were eluted with a linear 0-0.25 M NaCl gradient. Fractions were analyzed by SDS-PAGE using a Mini-PROTEAN TGX Stain-Free 4-15% Precast Gel (Bio-Rad Laboratories, CA, United States). Fractions containing a band at approximately 39 kDa were pooled. Then the pooled solution was concentrated by ultrafiltration.

Example 40: Cloning of GH62 Arabinofuranosidases from Coprinopsis cinerea, Remersonia thermophile and Bipolaris sorokiniana (SEQ ID NO: 135, 144 and 153)

The arabinofuranosidase encoding genes with the nucleotide sequences SEQ ID NO: 130, 139 and 148 were PCR amplified from genomic DNA isolated from Coprinopsis cinerea, Remersonia thermophile and Bipolaris sorokiniana and cloned into the Aspergillus expression vector pMStr366. The vector pMStr366 is a version of the expression vector pMStr57 (WO 04/032648) that has been modified to allow fusion of an insert CDS to a vector-encoded HIS tag with the sequence RHHHHHHP (SEQ ID NO: 91). The nucleotide sequences of the resulting fusions are shown in SEQ ID NO: 133, 142 and 151 and the peptide translations of the His-tagged proteins are shown in SEQ ID NO: 134, 143 and 152.

The sequences of the tagged arabinofuranosidase encoding genes cloned in the expression vector were confirmed, and the expression constructs were transformed into the Aspergillus oryzae strain MT3568 (WO 11/057140). Transformants were selected on acetamide during regeneration from protoplasts and subsequently re-isolated under selection (Christensen et al., 1988, Biotechnology 6, 1419-1422 and WO 04/032648).

For production of the recombinant arabinofuranosidases, a single Aspergillus transformant was selected for each arabinofuranosidase and the transformants were cultured in 500 ml baffled flasks containing 150 ml of DAP-4C-1 medium (WO 12/103350). The cultures were shaken on a rotary table at 150 RPM at 30° C. for 4 days. The culture broth was subsequently separated from cellular material by passage through a 0.22 um filter.

Example 41: Purification of the GH62 Arabinofuranosidases from Coprinopsis cinerea and Remersonia thermophila (SEQ ID NO: 135 and 144)

The GH62 arabinofuranosidases were purified as described in example 35.

Example 42: Purification of the GH62 Arabinofuranosidase from Bipolaris sorokiniana (SEQ ID NO: 153)

Filtrated broth was adjusted to pH7.0 and filtrated on 0.22 µm PES filter (Nalge Nunc International, Nalgene labware cat #595-4520). The filtrate was loaded onto a MEP Hypercel™ column (Pall Corporation, Long Island, N.Y., USA) equilibrated with 50 mM TRIS pH7.0. After wash with equilibration buffer, the bound proteins were batch eluted with 100 mM acetic acid pH 4.0. Fractions were collected and analyzed by SDS-PAGE. The fractions were pooled and applied to a Sephadex™ G-25 (medium) (GE Healthcare, Piscataway, N.J., USA) column equilibrated in 50 mM TRIS pH 7.0. The fractions were then applied to a SOURCE™ 15S (GE Healthcare, Piscataway, N.J., USA) column equilibrated in 50 mM TRIS pH 7.0 and bound proteins were eluted with a linear gradient from 0-1000 mM sodium chloride over 10 CV. Fractions were collected and analyzed by SDS-PAGE.

Example 43: Cloning of a GH10 Xylanase from Ustilago maydis (SEQ ID NO: 180)

A xylanase encoding gene with the nucleotide sequence SEQ ID NO: 175 was PCR amplified from genomic DNA isolated from Ustilago maydis and cloned into the Aspergillus expression vector pMStr366. The vector pMStr366 is a version of the expression vector pMStr57 (WO 04/032648) that has been modified to allow fusion of an insert CDS to a vector-encoded HIS tag with the sequence RHHHHHHP (SEQ ID NO: 91). The nucleotide sequence of the resulting fusion is shown in SEQ ID NO: 178 and the peptide translation of the His-tagged protein is shown in SEQ ID NO: 179.

The sequence of the tagged xylanase encoding gene cloned in the expression vector was confirmed, and the expression construct was transformed into the Aspergillus oryzae strain MT3568 (WO 11/057140). Transformants were selected on acetamide during regeneration from protoplasts and subsequently re-isolated under selection (Christensen et al., 1988, Biotechnology 6, 1419-1422 and WO 04/032648).

For production of the recombinant xylanase, a single Aspergillus transformant was selected and the transformant was cultured in 500 ml baffled flasks containing 150 ml of DAP-4C-1 medium (WO 12/103350). The cultures were shaken on a rotary table at 150 RPM at 30° C. for 3 days. The culture broth was subsequently separated from cellular material by passage through a 0.45 um filter.

Example 44: Purification of the GH10 Xylanase from Ustilago maydis (SEQ ID NO: 180)

pH was adjusted to pH 8, filtrated through a 0.2 µM, and the supernatant applied to a 5 ml HisTrap™ excel column. Prior to loading, the column had been equilibrated in 5 column volumes (CV) of 50 mM Tris/HCl pH 8. In order to remove unbound material, the column was washed with 8 CV of 50 mM Tris/HCl pH 8, and elution of the target was obtained with 50 mM HEPES pH 7+10 mM imidazole. The eluted protein was desalted on a HiPrep™ 26/10 desalting column, equilibrated using 3 CV of 50 mM HEPES pH 7+100 mM NaCl. This buffer was also used for elution of the target, and the flow rate was 10 ml/min. Relevant fractions were selected and pooled based on the chromatogram and SDS-PAGE analysis.

Example 45: Hydrolysis of Defatted Destarched Maize (DFDSM) Using a Combination of a GH10 Xylanase and a GH62 Arabinofuranosidase Defatted destarched maize (DFDSM, 400 mg) was added to aqueous sodium acetate (0.1 M, 3.9 mL) solution containing calcium chloride (5 mM) at pH 5 and the mixture heated to 40° C. for 30 minutes. 1004 buffer or enzyme solution was added and the sample was heated at 40° C. for 4 hours. The sample was cooled to 5° C. and centrifuged (4000 rpm, 5° C.) for 10 minutes. 1.7 mL of the sample was transferred to an Eppendorf tube and the enzyme deactivated by heating to 95° C. for 10 minutes. The samples were then frozen until hydrolysed (within 72 hours and xylose determination was performed immediately after hydrolysis).

The supernatant was thawed and centrifuged (14000 rpm) for 5 minutes. The supernatant (250 µL) was diluted with Milli-Q water (250 µL) in glass tubes and HCl (1.63 M, 2.0 mL) was added. The reaction was heated to 100° C. for 1 hour then cooled in an ice bath. Aqueous NaOH solution (1.3 M, 2.5 mL) was added whilst the samples were cooled on ice and the samples were stored at 0-5° C. whilst xylose content was analysed using the xylose assay. The results are presented in table 22.

TABLE 22

Xylose release from DFDSM using a GH10 xylanase (SEQ ID NO: 95) and four different GH62 arabinofuranosidases (SEQ ID NO: 21, 24, 27 or 44)

| GH10 Xylanase | Conc. [mg EP/ kg] | GH62 Arabino- furanosidase | Conc. [mg EP/ kg] | Soluble xylose (%) | Percent solubi- lised xylose[1] |
|---|---|---|---|---|---|
| Blank | — | None | — | 0.019 | 0.0 |
| SEQ ID NO: 95 | 25 | None | — | 0.164 | 1.0 |
| SEQ ID NO: 95 | 25 | SEQ ID NO: 24 | 12.5 | 0.385 | 2.5 |
| SEQ ID NO: 95 | 25 | SEQ ID NO: 44 | 12.5 | 0.374 | 2.4 |
| SEQ ID NO: 95 | 25 | SEQ ID NO: 27 | 12.5 | 0.325 | 2.1 |
| SEQ ID NO: 95 | 25 | SEQ ID NO: 21 | 12.5 | 0.317 | 2.0 |

Table 22 shows the amount of xylose measured after acid hydrolysis of supernatants (% of dry matter and % solubilized xylose of total xylose) when incubating DFDSM with SEQ ID NO: 95 (a GH10 xylanase corresponding to SEQ ID NO: 1 of WO2013/068550) alone or in combination with a GH62 arabinofuranosidase (SEQ ID NO: 21, 24, 27 or 44).
[1]Percentage solubilised xylose was calculated as described in example 23.

Conclusion

The results show that the percent solubilised xylose is significantly higher (at least 2 times) for all of the combinations of the prior art xylanase and GH62 arabinofuranosidase tested compared to the xylanase alone.

Example 46: Hydrolysis of Defatted Destarched Maize (DFDSM) Using a Combination of a GH11 Xylanase and a GH62 Arabinofuranosidase The experiment was performed as described in example 45 and the results are presented in tables 23 to 27 inclusive.

TABLE 23

Xylose release from DFDSM using two different GH11 xylanases (SEQ ID NO: 73 or 74) and a GH62 arabinofuranosidase (SEQ ID NO: 24)

| GH11 Xylanase | Conc. [mg EP/ kg] | GH62 Arabino- furanosidase | Conc. [mg EP/ kg] | Soluble xylose (%) | Percent solubi- lised xylose[1] |
|---|---|---|---|---|---|
| SEQ ID NO: 73 | 10 | None | — | 0.07[2] | 0.3 |
| SEQ ID NO: 74 | 10 | None | — | 0.17 | 0.9 |
| None | — | SEQ ID NO: 24 | 10 | 0.09 | 0.3 |
| SEQ ID NO: 73 | 10 | SEQ ID NO: 24 | 10 | 0.93 | 6.0 |
| SEQ ID NO: 73 | 10 | SEQ ID NO: 24 | 10 | 1.05 | 6.9 |
| SEQ ID NO: 74 | 10 | SEQ ID NO: 24 | 10 | 1.02 | 6.7 |

Table 23 shows the amount of xylose measured after acid hydrolysis of supernatants (% of dry matter and % solubilized xylose of total xylose) when incubating DFDSM with SEQ ID NO: 73 or 74 (a GH11 xylanase) alone or in combination with a GH62 arabinofuranosidase (SEQ ID NO: 24).
[1]Percentage solubilised xylose was calculated as described in example 23.

TABLE 24

Xylose release from DFDSM using a GH11 xylanase (SEQ ID NO: 73) and four different GH62 arabinofuranosidases (SEQ ID NO: 21, 27, 45 or 63)

| GH11 Xylanase | Conc. [mg EP/ kg] | GH62 Arabino- furanosidase | Conc. [mg EP/ kg] | Soluble xylose (%) | Percent solubi- lised xylose[1] |
|---|---|---|---|---|---|
| SEQ ID NO: 73 | 10 | None | — | 0.05 | 0.3 |
| SEQ ID NO: 73 | 10 | SEQ ID NO: 45 | 5 | 0.63 | 4.3 |
| SEQ ID NO: 73 | 10 | SEQ ID NO: 27 | 5 | 0.43 | 3.0 |
| SEQ ID NO: 73 | 10 | SEQ ID NO: 21 | 5 | 0.39 | 2.7 |
| SEQ ID NO: 73 | 10 | SEQ ID NO: 63 | 5 | 0.41 | 2.8 |

Table 24 shows the amount of xylose measured after acid hydrolysis of supernatants (% of dry matter and % solubilised xylose of total xylose) when incubating DFDSM with SEQ ID NO: 73 (a GH11 xylanase) alone or in combination with a GH62 arabinofuranosidase (SEQ ID NO 21, 27, 45 or 63).
[1]Percentage solubilised xylose was calculated as described in example 23.

TABLE 25

Xylose release from DFDSM using seven different GH11 xylanases (SEQ ID NO: 73, 74, 75, 78, 81, 88 or 89) and eight different GH62 arabinofuranosidases (SEQ ID NO: 15, 18, 21, 24, 39, 51, 57 or 69)

| GH11 Xylanase | Conc. [mg EP/ kg] | GH62 Arabino- furanosidase | Conc. [mg EP/ kg] | Soluble xylose (%) | Percent solubi- lised xylose[1] |
|---|---|---|---|---|---|
| None | — | None | — | 0.01 | 0.0 |
| SEQ ID NO: 73 | 10 | SEQ ID NO: 33 | 10 | 0.71 | 4.7 |
| SEQ ID NO: 73 | 10 | SEQ ID NO: 39 | 10 | 1.05 | 7.0 |
| SEQ ID NO: 73 | 10 | SEQ ID NO: 51 | 10 | 1.05 | 2.5 |
| SEQ ID NO: 73 | 10 | SEQ ID NO: 57 | 10 | 0.74 | 4.9 |
| SEQ ID NO: 73 | 10 | SEQ ID NO: 69 | 10 | 0.82 | 5.4 |
| None | — | None | — | 0.02 | 0.0 |
| SEQ ID NO: 78 | 10 | SEQ ID NO: 15 | 10 | 0.70 | 4.6 |
| SEQ ID NO: 78 | 10 | SEQ ID NO: 18 | 10 | 0.86 | 5.7 |
| SEQ ID NO: 78 | 10 | SEQ ID NO: 21 | 10 | 1.13 | 7.5 |
| SEQ ID NO: 78 | 10 | SEQ ID NO: 33 | 10 | 1.08 | 7.1 |
| SEQ ID NO: 78 | 10 | SEQ ID NO: 39 | 10 | 1.29 | 8.5 |
| None | — | None | — | 0.01 | 0 |
| SEQ ID NO: 74 | 10 | SEQ ID NO: 51 | 10 | 0.39 | 2.6 |
| SEQ ID NO: 75 | 10 | SEQ ID NO: 24 | 10 | 1.30 | 8.7 |
| SEQ ID NO: 75 | 10 | SEQ ID NO: 51 | 10 | 0.41 | 2.7 |
| SEQ ID NO: 81 | 10 | SEQ ID NO: 24 | 10 | 1.49 | 10.0 |
| SEQ ID NO: 81 | 10 | SEQ ID NO: 51 | 10 | 0.71 | 4.7 |
| None | — | None | — | 0.01 | 0 |
| SEQ ID NO: 87 | 10 | SEQ ID NO: 24 | 10 | 1.37 | 9.2 |
| SEQ ID NO: 87 | 10 | SEQ ID NO: 51 | 10 | 0.42 | 2.8 |
| SEQ ID NO: 88 | 10 | SEQ ID NO: 51 | 10 | 0.30 | 1.9 |
| SEQ ID NO: 89 | 10 | SEQ ID NO: 51 | 10 | 0.35 | 2.3 |

Table 25 shows the amount of xylose measured after acid hydrolysis of supernatants (% of dry matter and % solubilized xylose of total xylose) when incubating DFDSM with a GH11 xylanase (SEQ ID NO: 73, 74, 75, 78, 81, 88 or 89) in combination with a GH62 arabinofuranosidase (SEQ ID NO: 15, 18, 21, 24, 39, 51, 57 or 69).
[1]Percentage solubilised xylose was calculated as described in example 23.

TABLE 26

Xylose release from DFDSM using two different GH11 xylanases (SEQ ID NO: 73 or 78) and eight different GH62 arabinofuranosidases (SEQ ID NO: 111, 117, 120, 129, 135 138, 144 or 147)

| GH11 Xylanase | Conc. [mg EP/ kg] | GH62 Arabino- furanosidase | Conc. [mg EP/ kg] | Soluble xylose (%) | Percent solubi- lised xylose[1] |
|---|---|---|---|---|---|
| None | — | None | — | 0.01 | 0.0 |
| SEQ ID NO: 73 | 10 | SEQ ID NO: 111 | 10 | 0.73 | 4.8 |
| SEQ ID NO: 73 | 10 | SEQ ID NO: 117 | 10 | 0.74 | 4.9 |
| SEQ ID NO: 73 | 10 | SEQ ID NO: 120 | 10 | 0.56 | 3.7 |
| SEQ ID NO: 73 | 10 | SEQ ID NO: 129 | 10 | 0.71 | 4.7 |

TABLE 26-continued

Xylose release from DFDSM using two different GH11 xylanases (SEQ ID NO: 73 or 78) and eight different GH62 arabinofuranosidases (SEQ ID NO: 111, 117, 120, 129, 135 138, 144 or 147)

| GH11 Xylanase | Conc. [mg EP/ kg] | GH62 Arabino-furanosidase | Conc. [mg EP/ kg] | Soluble xylose (%) | Percent solubilised xylose[1] |
|---|---|---|---|---|---|
| SEQ ID NO: 73 | 10 | SEQ ID NO: 135 | 10 | 0.55 | 3.7 |
| SEQ ID NO: 73 | 10 | SEQ ID NO: 138 | 10 | 0.70 | 4.7 |
| SEQ ID NO: 73 | 10 | SEQ ID NO: 144 | 10 | 0.74 | 4.9 |
| SEQ ID NO: 73 | 10 | SEQ ID NO: 147 | 10 | 0.69 | 4.6 |
| None | — | None | — | 0.01 | 0.0 |
| SEQ ID NO: 78 | 10 | SEQ ID NO: 111 | 10 | 1.09 | 7.3 |
| SEQ ID NO: 78 | 10 | SEQ ID NO: 117 | 10 | 1.18 | 7.9 |
| SEQ ID NO: 78 | 10 | SEQ ID NO: 120 | 10 | 0.93 | 6.2 |
| SEQ ID NO: 78 | 10 | SEQ ID NO: 129 | 10 | 1.18 | 7.9 |
| SEQ ID NO: 78 | 10 | SEQ ID NO: 135 | 10 | 0.98 | 6.6 |
| SEQ ID NO: 78 | 10 | SEQ ID NO: 138 | 10 | 1.19 | 8.0 |
| SEQ ID NO: 78 | 10 | SEQ ID NO: 144 | 10 | 1.26 | 8.4 |
| SEQ ID NO: 78 | 10 | SEQ ID NO: 147 | 10 | 1.26 | 8.4 |

Table 26 shows the amount of xylose measured after acid hydrolysis of supernatants (% of dry matter and % solubilized xylose of total xylose) when incubating DFDSM with a GH11 xylanase (SEQ ID NO: 73 or 78) in combination with a GH62 arabinofuranosidase (SEQ ID NO: 111, 117, 120, 129, 135 138, 144 or 147).
[1]Percentage solubilised xylose was calculated as described in example 23.

TABLE 27

Xylose release from DFDSM using a GH11 xylanases (SEQ ID NO: 99) and a GH62 arabinofuranosidases (SEQ ID NO: 24)

| GH11 Xylanase | Conc. [mg EP/ kg] | GH62 Arabino-furanosidase | Conc. [mg EP/ kg] | Soluble xylose (%) | Percent solubilised xylose[1] |
|---|---|---|---|---|---|
| None | — | None | — | 0.01 | 0.0 |
| SEQ ID NO: 99 | 10 | None | — | 1.00 | 0.6 |
| SEQ ID NO: 99 | 10 | SEQ ID NO: 24 | 10 | 1.06 | 7.1 |

Table 27 shows the amount of xylose measured after acid hydrolysis of supernatants (% of dry matter and % solubilised xylose of total xylose) when incubating DFDSM with SEQ ID NO: 99 (a GH11 xylanase) alone or in combination with a GH62 arabinofuranosidase (SEQ ID NO: 24).

Conclusion

The results show that the percent solubilised xylose is significantly higher (at least 2 times) for the combinations of the GH11 xylanase and the GH62 arabinofuranosidases tested compared to the GH11 xylanase alone.

Example 47: Hydrolysis of Defatted Destarched Maize (DFDSM) Using a Combination of a GH10 Xylanase and a GH62 Arabinofuranosidase The experiment was performed as described in example 45 and the results are presented in tables 28 to 30 inclusive.

TABLE 28

Xylose release from DFDSM using three different GH10 xylanases (SEQ ID NO: 70, 71 or 72) and eight different GH62 arabinofuranosidases (SEQ ID NO: 24, 27, 45, 51, 57 or 69)

| GH10 Xylanase | Conc. [mg EP/ kg] | GH62 Arabino-furanosidase | Conc. [mg EP/ kg] | Soluble xylose (%) | Percent solubilised xylose[1] |
|---|---|---|---|---|---|
| None | — | None | — | 0.02 | 0.0 |
| SEQ ID NO: 72 | 10 | SEQ ID NO: 27 | 10 | 1.25 | 8.3 |
| SEQ ID NO: 72 | 10 | SEQ ID NO: 45 | 10 | 1.45 | 9.7 |
| SEQ ID NO: 72 | 10 | SEQ ID NO: 57 | 10 | 1.17 | 7.7 |
| SEQ ID NO: 72 | 10 | SEQ ID NO: 69 | 10 | 1.27 | 8.4 |
| None | — | None | — | 0.02 | 0.0 |
| SEQ ID NO: 70 | 10 | SEQ ID NO: 24 | 10 | 0.50 | 3.2 |
| SEQ ID NO: 70 | 10 | SEQ ID NO: 51 | 10 | 0.36 | 2.3 |
| SEQ ID NO: 71 | 10 | SEQ ID NO: 24 | 10 | 1.82 | 12.2 |
| SEQ ID NO: 71 | 10 | SEQ ID NO: 51 | 10 | 1.19 | 7.9 |

Table 28 shows the amount of xylose measured after acid hydrolysis of supernatants (% of dry matter and % solubilized xylose of total xylose) when incubating DFDSM with a GH10 xylanase (SEQ ID NO: 70, 71 or 72) in combination with a GH62 arabinofuranosidase (SEQ ID NO: 24, 27, 45, 51, 57 or 69).
[1]Percentage solubilised xylose was calculated as described in example 23.

TABLE 29

Xylose release from DFDSM using two different GH10 xylanases (SEQ ID NO: 70 and 72) and eight different GH62 arabinofuranosidases (SEQ ID NO: 111, 117, 120, 129, 135 138, 144 or 147)

| GH10 Xylanase | Conc. [mg EP/ kg] | GH62 Arabino-furanosidase | Conc. [mg EP/ kg] | Soluble xylose (%) | Percent solubilised xylose[1] |
|---|---|---|---|---|---|
| None | — | None | — | 0.01 | 0.0 |
| SEQ ID NO: 72 | 10 | SEQ ID NO: 111 | 10 | 0.93 | 6.2 |
| SEQ ID NO: 72 | 10 | SEQ ID NO: 117 | 10 | 1.02 | 6.8 |
| SEQ ID NO: 72 | 10 | SEQ ID NO: 120 | 10 | 0.83 | 5.5 |
| SEQ ID NO: 72 | 10 | SEQ ID NO: 129 | 10 | 1.17 | 7.8 |
| SEQ ID NO: 72 | 10 | SEQ ID NO: 135 | 10 | 0.91 | 6.1 |
| SEQ ID NO: 72 | 10 | SEQ ID NO: 138 | 10 | 1.17 | 7.8 |
| SEQ ID NO: 72 | 10 | SEQ ID NO: 144 | 10 | 1.02 | 6.8 |
| SEQ ID NO: 72 | 10 | SEQ ID NO: 147 | 10 | 1.12 | 7.5 |
| None | — | None | — | 0.00 | 0.0 |
| SEQ ID NO: 70 | 10 | SEQ ID NO: 111 | 10 | 0.44 | 2.9 |
| SEQ ID NO: 70 | 10 | SEQ ID NO: 117 | 10 | 0.39 | 2.6 |
| SEQ ID NO: 70 | 10 | SEQ ID NO: 120 | 10 | 0.39 | 2.6 |
| SEQ ID NO: 70 | 10 | SEQ ID NO: 129 | 10 | 0.55 | 3.7 |
| SEQ ID NO: 70 | 10 | SEQ ID NO: 135 | 10 | 0.36 | 2.4 |
| SEQ ID NO: 70 | 10 | SEQ ID NO: 138 | 10 | 0.42 | 2.8 |
| SEQ ID NO: 70 | 10 | SEQ ID NO: 144 | 10 | 0.39 | 2.6 |
| SEQ ID NO: 70 | 10 | SEQ ID NO: 147 | 10 | 0.40 | 2.6 |

Table 29 shows the amount of xylose measured after acid hydrolysis of supernatants (% of dry matter and % solubilized xylose of total xylose) when incubating DFDSM with a GH10 xylanase (SEQ ID NO: 70 or 72) in combination with a GH62 arabinofuranosidase (SEQ ID NO: 111, 117, 120, 129, 135 138, 144 or 147).
[1]Percentage solubilised xylose was calculated as described in example 23.

TABLE 30

Xylose release from DFDSM using two different GH10 xylanases (SEQ ID NO: 102 and 180) and a GH62 arabinofuranosidase (SEQ ID NO: 24)

| GH10 Xylanase | Conc. [mg EP/ kg] | GH62 Arabino-furanosidase | Conc. [mg EP/ kg] | Soluble xylose (%) | Percent solubilised xylose[1] |
|---|---|---|---|---|---|
| None | — | None | — | 0.01 | 0.0 |
| SEQ ID NO: 180 | 10 | None | — | 0.64 | 4.2 |
| SEQ ID NO: 180 | 10 | SEQ ID NO: 24 | 10 | 1.50 | 10.1 |
| SEQ ID NO: 102 | 10 | None | — | 0.11 | 0.7 |
| SEQ ID NO: 102 | 10 | SEQ ID NO: 24 | 10 | 0.75 | 5.0 |

Table 30 shows the amount of xylose measured after acid hydrolysis of supernatants (% of dry matter and % solubilized xylose of total xylose) when incubating DFDSM with SEQ ID NO: 102 or 180 (a GH10 xylanase) alone or in combination with a GH62 arabinofuranosidase (SEQ ID NO: 24).
[1]Percentage solubilised xylose was calculated as described in example 23.

Conclusion

The results show that the percent solubilised xylose is significantly higher (at least 2 times) for all of the combinations of GH10 xylanase and GH62 arabinofuranosidases tested compared to the GH10 xylanase alone.

Example 48: Hydrolysis of Defatted Destarched Maize (DFDSM) Using a Combination of a GH10 Xylanase and a GH62 Arabinofuranosidase The experiment was performed as described in example 45 and the results are presented in table 31.

TABLE 31

Xylose release from DFDSM using a GH10 xylanases (SEQ ID NO: 72) and ten different GH62 arabinofuranosidases (SEQ ID NO: 105, 123, 153, 156, 159, 162, 165, 168, 171 or 174)

| GH10 Xylanase | Conc. [mg EP/ kg] | GH62 Arabino-furanosidase | Conc. [mg EP/ kg] | Soluble xylose (%) | Percent solubilised xylose[1] |
|---|---|---|---|---|---|
| None | — | None | — | 0.005 | 0.0 |
| SEQ ID NO: 72 | 10 | None | 10 | 0.282 | 1.9 |
| SEQ ID NO: 72 | 10 | SEQ ID NO: 153 | 10 | 1.155 | 7.8 |
| SEQ ID NO: 72 | 10 | SEQ ID NO: 156 | 10 | 1.193 | 8.0 |
| SEQ ID NO: 72 | 10 | SEQ ID NO: 159 | 10 | 1.157 | 7.8 |
| SEQ ID NO: 72 | 10 | SEQ ID NO: 162 | 10 | 1.087 | 7.3 |
| SEQ ID NO: 72 | 10 | SEQ ID NO: 165 | 10 | 1.077 | 7.2 |
| SEQ ID NO: 72 | 10 | SEQ ID NO: 168 | 10 | 0.986 | 6.6 |
| SEQ ID NO: 72 | 10 | SEQ ID NO: 171 | 10 | 1.211 | 8.1 |
| SEQ ID NO: 72 | 10 | SEQ ID NO: 174 | 10 | 1.071 | 7.2 |
| SEQ ID NO: 72 | 10 | SEQ ID NO: 105 | 10 | 1.268 | 8.5 |
| SEQ ID NO: 72 | 10 | SEQ ID NO: 123 | 10 | 1.278 | 8.6 |

Table 31 shows the amount of xylose measured after acid hydrolysis of supernatants (% of dry matter and % solubilized xylose of total xylose) when incubating DFDSM with a GH10 xylanase (SEQ ID NO: 72) in combination with a GH62 arabinofuranosidase (SEQ ID NO: 105, 123, 153, 156, 159, 162, 165, 168, 171 or 174).
[1]Percentage solubilised xylose was calculated as described in example 23.

Conclusion

The results show that the percent solubilised xylose is significantly higher (at least 2 times) for all of the combinations of GH10 xylanase and GH62 arabinofuranosidases tested compared to the GH10 xylanase alone.

Example 49: Hydrolysis of Defatted Destarched Maize (DFDSM) Using a Combination of a GH11 Xylanase and a GH62 Arabinofuranosidase The experiment was performed as described in example 45 and the results are presented in tables 32 to 34 inclusive.

TABLE 32

Xylose release from DFDSM using a GH11 xylanases (SEQ ID NO: 78) and ten different GH62 arabinofuranosidases (SEQ ID NO: 105, 123, 153, 156, 159, 162, 165, 168, 171 or 174)

| GH11 Xylanase | Conc. [mg EP/ kg] | GH62 Arabino-furanosidase | Conc. [mg EP/ kg] | Soluble xylose (%) | Percent solubilised xylose[1] |
|---|---|---|---|---|---|
| None | — | None | — | 0.010 | 0.0 |
| SEQ ID NO: 78 | 10 | None | 10 | 0.352 | 2.3 |
| SEQ ID NO: 78 | 10 | SEQ ID NO: 153 | 10 | 1.165 | 7.8 |
| SEQ ID NO: 78 | 10 | SEQ ID NO: 156 | 10 | 1.148 | 7.7 |
| SEQ ID NO: 78 | 10 | SEQ ID NO: 159 | 10 | 1.085 | 7.3 |
| SEQ ID NO: 78 | 10 | SEQ ID NO: 162 | 10 | 1.183 | 7.9 |
| SEQ ID NO: 78 | 10 | SEQ ID NO: 165 | 10 | 1.132 | 7.6 |
| SEQ ID NO: 78 | 10 | SEQ ID NO: 168 | 10 | 0.906 | 6.1 |
| SEQ ID NO: 78 | 10 | SEQ ID NO: 171 | 10 | 1.118 | 7.5 |
| SEQ ID NO: 78 | 10 | SEQ ID NO: 174 | 10 | 1.106 | 7.4 |
| SEQ ID NO: 78 | 10 | SEQ ID NO: 105 | 10 | 1.212 | 8.1 |
| SEQ ID NO: 78 | 10 | SEQ ID NO: 123 | 10 | 1.172 | 7.9 |

Table 32 shows the amount of xylose measured after acid hydrolysis of supernatants (% of dry matter and % solubilized xylose of total xylose) when incubating DFDSM with a GH11 xylanase (SEQ ID NO: 78) in combination with a GH62 arabinofuranosidase (SEQ ID NO: 105, 123, 153, 156, 159, 162, 165, 168, 171 or 174).
[1]Percentage solubilised xylose was calculated as described in example 23.

TABLE 33

Xylose release from DFDSM using a GH11 xylanases (SEQ ID NO: 73) and ten different GH62 arabinofuranosidases (SEQ ID NO: 105, 123, 153, 156, 159, 162, 165, 168, 171 or 174)

| GH11 Xylanase | Conc. [mg EP/ kg] | GH62 Arabino-furanosidase | Conc. [mg EP/ kg] | Soluble xylose (%) | Percent solubilised xylose[1] |
|---|---|---|---|---|---|
| None | — | None | — | 0.000 | 0.0 |
| SEQ ID NO: 73 | 10 | None | 10 | 0.059 | 0.4 |
| SEQ ID NO: 73 | 10 | SEQ ID NO: 153 | 10 | 0.894 | 6.0 |
| SEQ ID NO: 73 | 10 | SEQ ID NO: 156 | 10 | 0.777 | 5.2 |
| SEQ ID NO: 73 | 10 | SEQ ID NO: 159 | 10 | 0.695 | 4.7 |
| SEQ ID NO: 73 | 10 | SEQ ID NO: 162 | 10 | 0.709 | 4.8 |
| SEQ ID NO: 73 | 10 | SEQ ID NO: 165 | 10 | 0.639 | 4.3 |
| SEQ ID NO: 73 | 10 | SEQ ID NO: 168 | 10 | 0.568 | 3.8 |
| SEQ ID NO: 73 | 10 | SEQ ID NO: 171 | 10 | 0.654 | 4.4 |
| SEQ ID NO: 73 | 10 | SEQ ID NO: 174 | 10 | 0.763 | 5.2 |
| SEQ ID NO: 73 | 10 | SEQ ID NO: 105 | 10 | 0.895 | 6.0 |
| SEQ ID NO: 73 | 10 | SEQ ID NO: 123 | 10 | 0.892 | 6.0 |

Table 33 shows the amount of xylose measured after acid hydrolysis of supernatants (% of dry matter and % solubilized xylose of total xylose) when incubating DFDSM with a GH11 xylanase (SEQ ID NO: 73) in combination with a GH62 arabinofuranosidase (SEQ ID NO: 105, 123, 153, 156, 159, 162, 165, 168, 171 or 174).
[1]Percentage solubilised xylose was calculated as described in example 23.

TABLE 34

Xylose release from DFDSM using a GH11 xylanases (SEQ ID NO: 96) and ten different GH62 arabinofuranosidases (SEQ ID NO: 105, 123, 153, 156, 159, 162, 165, 168, 171 or 174)

| GH11 Xylanase | Conc. [mg EP/ kg] | GH62 Arabino-furanosidase | Conc. [mg EP/ kg] | Soluble xylose (%) | Percent solubilised xylose[1] |
|---|---|---|---|---|---|
| None | — | None | — | 0.016 | 0.0 |
| SEQ ID NO: 96 | 10 | None | 10 | 0.198 | 1.2 |
| SEQ ID NO: 96 | 10 | SEQ ID NO: 153 | 10 | 1.153 | 7.7 |
| SEQ ID NO: 96 | 10 | SEQ ID NO: 156 | 10 | 1.108 | 7.4 |
| SEQ ID NO: 96 | 10 | SEQ ID NO: 159 | 10 | 1.037 | 6.9 |
| SEQ ID NO: 96 | 10 | SEQ ID NO: 162 | 10 | 1.020 | 6.8 |
| None | — | None | — | 0.014 | 0.0 |
| SEQ ID NO: 96 | 10 | None | 10 | 0.200 | 1.2 |
| SEQ ID NO: 96 | 10 | SEQ ID NO: 165 | 10 | 1.021 | 6.8 |
| SEQ ID NO: 96 | 10 | SEQ ID NO: 168 | 10 | 0.811 | 5.4 |
| SEQ ID NO: 96 | 10 | SEQ ID NO: 171 | 10 | 0.933 | 6.2 |
| SEQ ID NO: 96 | 10 | SEQ ID NO: 174 | 10 | 0.994 | 6.6 |
| SEQ ID NO: 96 | 10 | SEQ ID NO: 105 | 10 | 1.025 | 6.9 |
| SEQ ID NO: 96 | 10 | SEQ ID NO: 123 | 10 | 0.993 | 6.7 |

Table 34 shows the amount of xylose measured after acid hydrolysis of supernatants (% of dry matter and % solubilized xylose of total xylose) when incubating DFDSM with a GH11 xylanase (SEQ ID NO: 96) in combination with a GH62 arabinofuranosidase (SEQ ID NO: 105, 123, 153, 156, 159, 162, 165, 168, 171 or 174).
[1]Percentage solubilised xylose was calculated as described in example 23.

Conclusion

The results show that the percent solubilised xylose is significantly higher (at least 2 times) for all of the combinations of GH11 xylanase and GH62 arabinofuranosidases tested compared to the GH11 xylanase alone.

Example 50: Determination of Hydrolysis of Arabinoxylans in Corn and Wheat DDGS Substrate Corn DDGS from a European corn-based fuel ethanol plant was used as substrate (93.35% dry substrate). Wheat DDGS from a European wheat-based fuel ethanol plant was used as substrate (92.43% dry substrate) The DDGS was ground in a coffee blender for 3-4 minutes and washed extensively in water (six times, each wash followed by centrifugation at 3000 rpm for 15 minutes) to remove soluble dry matter.

After the repeated washings the amount of dry substrate (DS) was measured and a 15% DS slurry in water was prepared for the trial and adjusted to pH 4.8 using 1M NaOH.

Enzymes

The enzymes used were the GH10 xylanase from *Aspergillus aculeatus* (SEQ ID NO: 72) and the GH62 arabinofuranosidase from *Penicillium capsulatum* (SEQ ID NO: 9).

Assay 4 g slurry was transferred to a PCR-tube plate. Sodium azide (0.05%) and enzyme (see table 30) was added each well. The plate was covered with a manual plate-sealer and the samples were incubated for 24 hours at 40° C. and 500 rpm, with samples taken after 0 and 24 hours. The samples were boiled for 10 minutes to deactivate the enzymes, centrifuged and filtered (0.2 µm filter).

TABLE 35

Experimental design and enzyme doses

| Test | Substrate | Enzyme | Dose (µg e.p./g DS) | Repeats |
|---|---|---|---|---|
| 1 | Wheat DDGS | Blank | 0 | 2 |
| 2 | Wheat DDGS | GH 10 (SEQ ID NO: 72) | 30 | 2 |
| 3 | Wheat DDGS | GH 62 (SEQ ID NO: 9) | 30 | 2 |
| 4 | Wheat DDGS | GH 10 (SEQ ID NO: 72) + GH 62 (SEQ ID NO: 9) | 20 + 10 | 2 |
| 5 | Wheat DDGS | GH 10 (SEQ ID NO: 72) + GH 62 (SEQ ID NO: 9) | 15 + 15 | 2 |
| 6 | Wheat DDGS | GH 10 (SEQ ID NO: 72) + GH 62 (SEQ ID NO: 9) | 30 + 30 | 2 |
| 7 | Corn DDGS | Blank | 0 | 2 |
| 8 | Corn DDGS | GH 10 (SEQ ID NO: 72) | 30 | 2 |
| 9 | Corn DDGS | GH 62 (SEQ ID NO: 9) | 30 | 2 |
| 10 | Corn DDGS | GH 10 (SEQ ID NO: 72) + GH 62 (SEQ ID NO: 9) | 20 + 10 | 2 |
| 11 | Corn DDGS | GH 10 (SEQ ID NO: 72) + GH 62 (SEQ ID NO: 9) | 15 + 15 | 2 |
| 12 | Corn DDGS | GH 10 (SEQ ID NO: 72) + GH 62 (SEQ ID NO: 9) | 30 + 30 | 2 |

Analytical Methods

1. Brix Measurements

The soluble dry substance (Brix) was measured using a Mettler Toledo Brix meter.

2. Absorption at 320 nm

Adsorption at 320 nm was measured after 50× dilution with water. Adsorption at 320 nm is a measure of the soluble fragments containing ferulic acid. The assay was calibrated with a ferulic acid standard (A320 (OD)=0.0147+0.0628*[concentration of ferulic acid in µg/ml])

3. Xylose (for 24 Hour Samples)

Xylose content was determined using the "D-xylose assay kit" from Megazymes.

Results

TABLE 36

Soluble dry matter as determined using the Brix measurement

| Test | Substrate/enzyme | 0 hours | Sample 1 (mg/mL) | Sample 2 (mg/mL) |
|---|---|---|---|---|
| 1 | Wheat, blank | 0.99 | 1.26 | 1.4 |
| 2 | Wheat, GH10 | 0.99 | 2.03 | 2.1 |
| 3 | Wheat, GH62 | 0.99 | 1.54 | 1.4 |
| 4 | Wheat, GH10 + GH62 | 0.99 | 1.96 | 2.23 |
| 5 | Wheat, GH10 + GH62 | 0.99 | 1.96 | 2.23 |
| 6 | Wheat, GH10 + GH62 | 0.99 | 2.17 | 2.17 |
| 7 | Corn, blank | 0.43 | 0.64 | 0.64 |
| 8 | Corn, GH10 | 0.43 | 1.2 | 1.2 |
| 9 | Corn, GH62 | 0.43 | 0.71 | 0.71 |
| 10 | Corn, GH10 + GH62 | 0.43 | 1.61 | 1.68 |
| 11 | Corn, GH10 + GH62 | 0.43 | 1.75 | 1.68 |
| 12 | Corn, GH10 + GH62 | 0.43 | 1.75 | 1.82 |

TABLE 37

Amount of soluble fragments containing ferulic acid measured by adsorption at 320 nm

| Test | Substrate/enzyme | 0 hours | Sample 1 (mg/mL) | Sample 2 (mg/mL) |
|---|---|---|---|---|
| 1 | Wheat, blank | 0.163 | 0.258 | 0.328 |
| 2 | Wheat, GH10 | 0.163 | 0.347 | 0.378 |
| 3 | Wheat, GH62 | 0.163 | 0.215 | 0.261 |
| 4 | Wheat, GH10 + GH62 | 0.163 | 0.354 | 0.424 |
| 5 | Wheat, GH10 + GH62 | 0.163 | 0.359 | 0.421 |
| 6 | Wheat, GH10 + GH62 | 0.163 | 0.368 | 0.375 |
| 7 | Corn, blank | 0.027 | 0.043 | 0.047 |
| 8 | Corn, GH10 | 0.027 | 0.279 | 0.287 |
| 9 | Corn, GH62 | 0.027 | 0.061 | 0.047 |
| 10 | Corn, GH10 + GH62 | 0.027 | 0.432 | 0.456 |
| 11 | Corn, GH10 + GH62 | 0.027 | 0.504 | 0.475 |
| 12 | Corn, GH10 + GH62 | 0.027 | 0.510 | 0.534 |

TABLE 38

Xylose release from DDGS

| Test | Substrate/enzyme | 0 hours | Sample 1 (mg/mL) | Sample 2 (mg/mL) |
|---|---|---|---|---|
| 1 | Wheat, blank | 1.38 | 1.56 | 1.73 |
| 2 | Wheat, GH10 | 1.38 | 5.57 | 6.00 |
| 3 | Wheat, GH62 | 1.38 | 1.67 | 1.77 |
| 4 | Wheat, GH10 + GH62 | 1.38 | 5.44 | 6.09 |
| 5 | Wheat, GH10 + GH62 | 1.38 | 6.17 | 5.55 |
| 6 | Wheat, GH10 + GH62 | 1.38 | 5.71 | 5.91 |
| 7 | Corn, blank | 0.06 | 0.13 | 0.12 |
| 8 | Corn, GH10 | 0.06 | 2.49 | 2.47 |
| 9 | Corn, GH62 | 0.06 | 0.37 | 0.34 |
| 10 | Corn, GH10 + GH62 | 0.06 | 4.50 | 4.35 |
| 11 | Corn, GH10 + GH62 | 0.06 | 4.50 | 4.30 |
| 12 | Corn, GH10 + GH62 | 0.06 | 4.16 | 4.63 |

It is concluded from the data in this example that for wheat DDGS, the GH10 xylanase (SEQ ID NO: 72) is able to fully degrade the substrate and the addition of a GH62 arabinofuranosidase does not give any additional release of xylose.

For corn DDGS the GH10 xylanase alone (SEQ ID NO: 72) is unable to fully degrade the substrate. However, when the GH62 arabinofuranosidase (SEQ ID NO: 9) is added, the release of xylose is significantly improved. This example clearly shows the difference between the less substituted wheat based substrate and highly substituted corn based substrate and that the combination of a GH10 xylanase and GH62 arabinofuranosidase is significantly better than a GH10 xylanase alone on corn based substrates.

SEQUENCE LISTING (180 sequences)

SEQ ID NO: 1 - protein, 9 aa, Artificial Sequence
  Conserved motif: [H/Y][L/M]F[F/S][A/C/H/S/T/V][A/D/G/N/R]D[D/E/N]G
  misc_feature (1)..(1): The amino acid in position 1 of the conserved motif is either histidine (His, H) or tyrosine (Tyr, Y).
  misc_feature (2)..(2): The amino acid in position 2 of the conserved motif is either leucine (Leu, L) or methionine (Met, M).
  misc_feature (4)..(4): The amino acid in position 4 of the conserved motif is either phenylalanine (Phy, F) or serine (Ser, S).
  misc_feature (5)..(5): The amino acid in position 5 of the conserved motif is either alanine (Ala, A), cysteine (Cys, C), histidine (His, H), serine (Ser, S), threonine (Thr, T) or valine (Val, V).
  misc_feature (6)..(6): The amino acid in position 6 of the conserved motif is either alanine (Ala, A), aspartic acid (Asp, D), glycine (Gly, G), asparagine (Asn, N) or arginine (Arg, R).
  misc_feature (8)..(8): The amino acid in position 8 of the conserved motif is either aspartic acid (Asp, D), glutamic acid (Glu, E) or asparagine (Asn, N).
XXFXXXDXG

SEQ ID NO: 2 - protein, 9 aa, Artificial Sequence
  Conserved motif: [H/Y]LF[F/S][A/S/V][A/D/G]DNG
  misc_feature (1)..(1): The amino acid in position 1 of the conserved motif is either histidine (His, H) or tyrosine (Tyr, Y).
  misc_feature (4)..(4): The amino acid in position 4 of the conserved motif is either phenylalanine (Phy, F) or serine (Ser, S).
  misc_feature (5)..(5): The amino acid in position 5 of the conserved motif is either Alanine (Ala, A), Serine (Ser, S) or Valine (Val, V).
  misc_feature (6)..(6): The amino acid in position 6 of the conserved motif is either Alanine (Ala, A), aspartic acid (Asp, D) or Glycine (Gly, G).
XLFXXXDNG

SEQ ID NO: 3 - protein, 9 aa, Artificial Sequence
  Conserved motif: YLFF[A/V][A/G]DNG
  misc_feature (5)..(5): The amino acid in position 5 of the conserved motif is either Alanine (Ala, A) or Valine (Val, V).
  misc_feature (6)..(6): The amino acid in position 6 of the conserved motif is either Alanine (Ala, A) or Glycine (Gly, G).
YLFFXXDNG

SEQ ID NO: 4 - protein, 9 aa, Artificial Sequence
  Conserved motif: YLFFAGDNG
YLFFAGDNG

SEQ ID NO: 5 - protein, 9 aa, Artificial Sequence
  Conserved motif: [H/Y]LFSSDDNG
  misc_feature (1)..(1): The amino acid in position 1 of the conserved motif is either histidine (His, H) or tyrosine (Tyr, Y).
XLFSSDDNG

SEQ ID NO: 6 - protein, 9 aa, Artificial Sequence
  Conserved motif: YLFSSDDNG
YLFSSDDNG

SEQ ID NO: 7 - DNA, 987 bp, Penicillium capsulatum
  CDS (1)..(984)
  sig_peptide (1)..(78)
  mat_peptide (79)..(984)
atgagattcttccaagcgaaagctggcctgatatcatcagggataactttgctcgcgtcagtgccagtagtcatcgccaattgcgcccttccatcgacatatagctggacatcaactagcgctttagcgaatcccaagcccgggtggacagcaatcaaggattttaccaatgtggtcttcaataacaggcatgtcgtctatgcatctaccaccgacacaagtgggaactacggcgcaatgagcttcggtgtcttttcggattggcctggcatggcatctgcgagccaaaacgcattgagctttgcagccgtcgcacccaccttgttctactttcagccaaaaagtatatgggttctggcctatcaatggggctctagcacgtttacctaccgaacatcaagtgatcccaccaatgcctatggatggtcatcggagcaagcccttttctctgggaaagttaccggctcgagcactggcgccattgatcagacacttatcggtgacgccacgcatatgtatcttttctttgccggagacaatggcaaaatatatcgctctagcatgcccatcagcaatttccctggaaactttggaacagtgtcagaggtggtactaagtgacactcagaataatctatttgaggcggtccaagtgtacactgtgaaaggtcaaaaccagtacctgatgatcgttgaggcaattggatcagaagggcggtatttccgttcattcactgccagcagtcttggtggtttgtggactgcccaggcagcaagcgagactaagccctttgctggtaaagccaatagcggtgcaacctggaccaacgacatcagtcacggcgatttggttcgttccaaccctgaccaaacaatgacgatcgatccatgcaacctgcaattcctctaccagggacgaaatcctggcgcaagtggcaactacaataccttaccgtggaggccgggtgtgctcactttgaataattaa

SEQ ID NO: 8 - protein, 328 aa, Penicillium capsulatum
MRFFQAKAGLISSGITLLASVPVVIANCALPSTYSWTSTSALANPKPGWTAIKDFTNVVFNNRHVVYASTTDTSGNYGAMSFGVFSDWPGMASASQNALSFAAVAPTLFYFQPKSIWVLAYQWGSSTFTYRTSSDPTNAYGWSSEQALFSGKVTGSSTGAIDQTLIGDATHMYLFFAGDNGKIYRSSMPISNFPGNFGTVSEVVLSDTQNNLFEAVQVYTVKGQNQYLMIVEAIGSEGRYFRSFTASSLGGLWTAQAASETKPFAGKANSGATWTNDISHGDLVRSNPDQTMTIDPCNLQFLYQGRNPGASGNYNTLPWRPGVLTLNN

SEQ ID NO: 9 - protein, 302 aa, Penicillium capsulatum
NCALPSTYSWTSTSALANPKPGWTAIKDFTNVVFNNRHVVYASTTDTSGNYGAMSFGVFSDWPGMASASQNALSFAAVAPTLFYFQPKSIWVLAYQWGSSTFTYRTSSDPTNAYGWSSEQALFSGKVTGSSTGAIDQTLIGDATHMYLFFAGDNGKIYRSSMPISNFPGNFGTVSEVVLSDTQNNLFEAVQVYTVKGQNQYLMIVEAIGSEGRYFRSFTASSLGGLWTAQAASETKPFAGKANSGATWTNDISHGDLVRSNPDQTMTIDPCNLQFLYQGRNPGASGNYNTLPWRPGVLTLNN

SEQ ID NO: 10 - DNA, 990 bp, Penicillium aurantiogriseum
  CDS (1)..(987)
  sig_peptide (1)..(78)
  mat_peptide (79)..(987)
atgaaattctccaaggcaaaagctggcctggtgtcatctggcatgctgttgctcgcatcagtaccagttgccgtcgccgactgcgcgcttccatcaacttatacttggacatcaactggcgctctagcgaatccaaagtccggatggaccgcaatcaaggatttcaccaacgttgttgttaacaataagcatctcgtatatgcatcaaccaccgacgcaagtgggaactacggcgcgatgaacttcggtcccttttcggattggtctggcatggcaactgcgagtcaaatcaaaacgagctttaacgctgttgcgcccactttgttctacttccagccaaaggacatttgggtcatagcctaccaatggggctcaagcacgtttacctatcgaacatcaagtgatcctaccaatgccaatggatggtcatcggagcaagcccttttttccgggaagatcaccgccccggatgctgctattgatcagaccgttatcggtgactctacgcacatgtaccttttcttcgctggggacaatggcaagatctatcgcagcagcatgtctatcgacaagttccctggaaacttcggaacaagttcggaaatagtactgagtggcgctaggaacgacctgttcgaagcagttcaagtgtacactgttaagggtcagaacaagtaccttatgcttgtcgaagcaattggagcacaagggcagcggtatttccgttcattcgtctccagcagtctcggcggtaagtgggaaccgcaggcagcaagcgagagcaagcccttcgccggaaaagccaatgtcggtgcaacctggaccaaggacttcagtcacggtgatttggttcgaaccaaccctgaccaaacaatgaccgtcgatccatgcaacctgcaactcctctaccagggacgggatcccaccgccaccagtagtaactacaataccataccgtggcagcccgccgttctcaccctgaagaagtaa

SEQ ID NO: 11 - protein, 329 aa, Penicillium aurantiogriseum
MKFSKAKAGLVSSGMLLLASVPVAVADCALPSTYTWTSTGALANPKSGWTAIKDFTNVVVNNKHLVYASTTDASGNYGAMNFGPFSDWSGMATASQIKTSFNAVAPTLFYFQPKDIWVIAYQWGSSTFTYRTSSDPTNANGWSSEQALFSGKITAPDAAIDQTVIGDSTHMYLFFAGDNGKIYRSSMSIDKFPGNFGTSSEIVLSGARNDLFEAVQVYTVKGQNKYLMLVEAIGAQGQRYFRSFVSSSLGGKWEPQAASESKPFAGKANVGATWTKDFSHGDLVRTNPDQTMTVDPCNLQLLYQGRDPTATSSNYNTIPWQPAVLTLKK

SEQ ID NO: 12 - protein, 303 aa, Penicillium aurantiogriseum
DCALPSTYTWTSTGALANPKSGWTAIKDFTNVVVNNKHLVYASTTDASGNYGAMNFGPFSDWSGMATASQIKTSFNAVAPTLFYFQPKDIWVIAYQWGSSTFTYRTSSDPTNANGWSSEQALFSGKITAPDAAIDQTVIGDSTHMYLFFAGDNGKIYRSSMSIDKFPGNFGTSSEIVLSGARNDLFEAVQVYTVKGQNKYLMLVEAIGAQGQRYFRSFVSSSLGGKWEPQAASESKPFAGKANVGATWTKDFSHGDLVRTNPDQTMTVDPCNLQLLYQGRDPTATSSNYNTIPWQPAVLTLKK

SEQ ID NO: 13 - DNA, 1212 bp, Artificial Sequence
  codon optimised DNA sequence
  CDS (1)..(1209)
  sig_peptide (1)..(63)
  mat_peptide (64)..(1209)
atgatcttgtcggcgaagatgctcggagcgattctcttggagttggccctcacagcagcagcgcagcagactctctacggccagtgtggaggcaacggctggacaggacccacccagtgtgtgtcgggagcctgttgtcagatccagaacccctggtattcgcagtgtctccctggctcctgttccccctccaccactttgacacgggtcacaacaaccgcaacatccactgcatccacagccacttccggcacaggaggctccttgccctcgtccttcaagtggtcgtcgtccggacccttggtcgaccctaagaacgacggtcgaggcatcgcagcgttgaaagatccgtcgatcgtcgaggtcgatggcacatatcacgtgttcgcatcgactgcaacttcggcaggctacaacatggtgtatttcaacttcaccgatttcaaccaggcaaacaacgcacccttcttctatttggacaaatcgcctattggctcgggataccgagccgcaccccaggtcttcttcttcaagccccagaacttgtggtacctcgtctaccagaacggcaacgcagcctactcgaccaacaaagatatctccaaccctgcaggctggtccgcacccaagacattctactcgtcgcagccctcgatcatcacagagaacatcggtaacggttactgggtcgatatgtgggtcatctgtgattcggccaactgtcacttgttctcgtccgacgataacggccatttgtaccgctcgcagacgacgttggcgaacttccccaacggtatgaccaacacagtgatcgcgatgcaggactcgaaccccaacaacttgttcgaggcatccaacgtctaccatgtgggaggcggtaagtatctcctcattgtcgaggccatcggctccggaggcgaccgatacttccggtcgtggacgtcgacgtccctcactggtacctggactgcactcgcagcatcggaatcgaaccctttcgcaggtgccaagaacgtggccttctccggcaacgtctggaccaaatccatctcgcacggagagatgatccgagaccaggtggatcagaccttgacaatctccccgtgtaagctcaggtacttgtaccagggcgtcgatccggcagcaaccggtaactacaactcgttgccgtggaagctcgcgctcctcacgcagacgaactcggcatgttga

SEQ ID NO: 14 - protein, 403 aa, Artificial Sequence
  Synthetic Construct
MILSAKMLGAILLELALTAAAQQTLYGQCGGNGWTGPTQCVSGACCQIQNPWYSQCLPGSCSPSTTLTRVTTTATSTASTATSGTGGSLPSSFKWSSSGPLVDPKNDGRGIAALKDPSIVEVDGTYHVFASTATSAGYNMVYFNFTDFNQANNAPFFYLDKSPIGSGYRAAPQVFFFKPQNLWYLVYQNGNAAYSTNKDISNPAGWSAPKTFYSSQPSIITENIGNGYWVDMWVICDSANCHLFSSDDNGHLYRSQTTLANFPNGMTNTVIAMQDSNPNNLFEASNVYHVGGGKYLLIVEAIGSGGDRYFRSWTSTSLTGTWTALAASESNPFAGAKNVAFSGNVWTKSISHGEMIRDQVDQTLTISPCKLRYLYQGVDPAATGNYNSLPWKLALLTQTNSAC

SEQ ID NO: 15 - protein, 382 aa, Aspergillus clavatus
QQTLYGQCGGNGWTGPTQCVSGACCQIQNPWYSQCLPGSCSPSTTLTRVTTTATSTASTATSGTGGSLPSSFKWSSSGPLVDPKNDGRGIAALKDPSIVEVDGTYHVFASTATSAGYNMVYFNFTDFNQANNAPFFYLDKSPIGSGYRAAPQVFFFKPQNLWYLVYQNGNAAYSTNKDISNPAGWSAPKTFYSSQPSIITENIGNGYWVDMWVICDSANCHLFSSDDNGHLYRSQTTLANFPNGMTNTVIAMQDSNPNNLFEASNVYHVGGGKYLLIVEAIGSGGDRYFRSWTSTSLTGTWTALAASESNPFAGAKNVAFSGNVWTKSISHGEMIRDQVDQTLTISPCKLRYLYQGVDPAATGNYNSLPWKLALLTQTNSAC

SEQ ID NO: 16 - DNA, 1188 bp, Artificial Sequence
  codon optimised DNA sequence
  CDS (1)..(1185)
  sig_peptide (1)..(51)
  mat_peptide (52)..(1185)
atgaaggcgatcggagcgaccctcctcggattggccctcgcggtgcaggcacagcagccgctctatgcacagtgtggaggcaacggatggaccggttcgacgcagtgtgtggcaggtgcctgttgttcgtccattaacgcctggtactatcagtgtttgtccggaaactgtatgccctcgacaacgatgacgacaaccgcaactaggaccacatcgacctccacgtccggacccacgggctccttgcctccttccttcaagtggtcctcgaccaacgccctcgtgggtcctaagaacgatggccgaaacctcgcaggtatcaaagatccgtccatcatcgaagtggacggcacataccatgtgttcgcctcgacagcgcaggcctccggctataacttggtctacttcaacttcaccgacttcaaccaggcaggtaacgcacccttcttctacttggatcagtcgggcattggcacaggttatcgggcagcaccccaggtgttctacttccagcctcagcagttgtggtacctcatcttccagaacggaaacgcagcatactcgaccaacaaggatatctccaaccctgcaggttggtccgcaccgaaaaacttcttctcctcggtcccttccattatcacgcagaacatcggtaacggctactgggtcgatatgtgggtcatctgtgactcgtccaactgttacttgttctcctcggatgacaacggccatctctaccgatcccagacgacgttgtcgaacttccccaacggcatgggtaacaccgtcatcgccctctcggattccaaccccaacaacttgttcgaggcctcgaacgtctaccgggtgggcaacgagtacctcctcatcgtcgaggcaatcggttccgatggaaacaggtatttccgctcgtggacagcaccgtcgctcacaggtacgtggacaggcctcgcaaacacagaagccaaccccttcgccaggtggaacaacgtcgtgttctccggcacggcctggactaagtcgatctcgcacggcgagatggtgcgatcccaggtcgaccagacgatgacaatttcgccgtgtaagttgaggtacttgtatcagggcttgtcgcccactgcaacaggcgactataactccttgccctggaagttggccctcctcacccagacaaactcggcatgttag

SEQ ID NO: 17 - protein, 395 aa, Artificial Sequence
  Synthetic Construct
MKAIGATLLGLALAVQAQQPLYAQCGGNGWTGSTQCVAGACCSSINAWYYQCLSGNCMPSTTMTTTATRTTSTSTSGPTGSLPPSFKWSSTNALVGPKNDGRNLAGIKDPSIIEVDGTYHVFASTAQASGYNLVYFNFTDFNQAGNAPFFYLDQSGIGTGYRAAPQVFYFQPQQLWYLIFQNGNAAYSTNKDISNPAGWSAPKNFFSSVPSIITQNIGNGYWVDMWVICDSSNCYLFSSDDNGHLYRSQTTLSNFPNGMGNTVIALSDSNPNNLFEASNVYRVGNEYLLIVEAIGSDGNRYFRSWTAPSLTGTWTGLANTEANPFARWNNVVFSGTAWTKSISHGEMVRSQVDQTMTISPCKLRYLYQGLSPTATGDYNSLPWKLALLTQTNSAC

SEQ ID NO: 18 - protein, 378 aa, Neosartorya fischeri
QQPLYAQCGGNGWTGSTQCVAGACCSSINAWYYQCLSGNCMPSTTMTTTATRTTSTSTSGPTGSLPPSFKWSSTNALVGPKNDGRNLAGIKDPSIIEVDGTYHVFASTAQASGYNLVYFNFTDFNQAGNAPFFYLDQSGIGTGYRAAPQVFYFQPQQLWYLIFQNGNAAYSTNKDISNPAGWSAPKNFFSSVPSIITQNIGNGYWVDMWVICDSSNCYLFSSDDNGHLYRSQTTLSNFPNGMGNTVIALSDSNPNNLFEASNVYRVGNEYLLIVEAIGSDGNRYFRSWTAPSLTGTWTGLANTEANPFARWNNVVFSGTAWTKSISHGEMVRSQVDQTMTISPCKLRYLYQGLSPTATGDYNSLPWKLALLTQTNSAC

SEQ ID NO: 19 - DNA, 996 bp, Artificial Sequence
  codon optimised DNA sequence
  CDS (1)..(993)
  sig_peptide (1)..(60)
  mat_peptide (61)..(993)
atgaaattgtcctgtgcattcgtcgcagtggcagcattggtggcgaccgcagtggaggccaaccccgagaccgaacgaaggcggtcctgtgcgctccctacaacatatcggtggacgtcctcggcaccgctcgcccagcccaaggatggctgggtctccttgaaagatttcactcatgtcccgtacaacggacagcacttggtgtatgcatcctaccatgattcgaccaagtatggatcgatggcattctcccccttcaagcactgggcagatatggcgacagcaacccagacgggaatgacacaggcagccgtggcaccgacggtgttctacttcacacccaaaaagctctggttcttggtgtcccagtggggttcggcacccttcacataccggacttcgacggaccctacaaaagtcaacggctggtcggcaccccagcccctcttcacgggcaaagtggcagattccggcacaggaccgatcgatcagacagtgatcgcggatgaccggaaggtctacttgttcttcgtcgcagacaacggaaaggtgtaccgcacatccatggcaattggagacttccctgccaacttcggcacagcctccgaggtgattttgtcggatacccaggcaaagttgttcgaagcagtccaggtctacaccgtggcaggtcagaaccagtacctcatgatcgtggaggcccagggtaccaacggaaggtacttccggtccttcactgcaaactcgttggatggagagtggaaggtgcaggcaggctcggagtccgcacctttcgcaggcaaggccaactcgggagcgtcctggaccaacgatgtctcccacggtgatctcattaggtccaacccggatcagacaatgaccatcgatccttgtcgcctccagctcctctaccagggacgcgacaagaacaaggtcccgtcgtcctatgatttggcaccgtatcgccctggcctcctcaccttgtatggcctctag

SEQ ID NO: 20 - protein, 331 aa, Artificial Sequence
  Synthetic Construct
MKLSCAFVAVAALVATAVEANPETERRRSCALPTTYRWTSSAPLAQPKDGWVSLKDFTHVPYNGQHLVYASYHDSTKYGSMAFSPFKHWADMATATQTGMTQAAVAPTVFYFTPKKLWFLVSQWGSAPFTYRTSTDPTKVNGWSAPQPLFTGKVADSGTGPIDQTVIADDRKVYLFFVADNGKVYRTSMAIGDFPANFGTASEVILSDTQAKLFEAVQVYTVAGQNQYLMIVEAQGTNGRYFRSFTANSLDGEWKVQAGSESAPFAGKANSGASWTNDVSHGDLIRSNPDQTMTIDPCRLQLLYQGRDKNKVPSSYDLAPYRPGLLTLYGL

SEQ ID NO: 21 - protein, 311 aa, Ustilago maydis
NPETERRRSCALPTTYRWTSSAPLAQPKDGWVSLKDFTHVPYNGQHLVYASYHDSTKYGSMAFSPFKHWADMATATQTGMTQAAVAPTVFYFTPKKLWFLVSQWGSAPFTYRTSTDPTKVNGWSAPQPLFTGKVADSGTGPIDQTVIADDRKVYLFFVADNGKVYRTSMAIGDFPANFGTASEVILSDTQAKLFEAVQVYTVAGQNQYLMIVEAQGTNGRYFRSFTANSLDGEWKVQAGSESAPFAGKANSGASWTNDVSHGDLIRSNPDQTMTIDPCRLQLLYQGRDKNKVPSSYDLAPYRPGLLTLYGL

SEQ ID NO: 22 - DNA, 996 bp, Penicillium oxalicum
  CDS (1)..(993)
  sig_peptide (1)..(87)
  mat_peptide (88)..(993)
atgcgttcccctatctctaacctcgacctgtggtcgtctttcactgtgcttctcgcatcggctggtacccttgcgagtgccgcgtgccccgtcccctcccagggtcaataccgctggtcttccaccggtgccctggctcagcctcagcacggctggacttccatcaaggacttcaccaacgttgtctacaacggcaagcaccttgtctacgcctccgtggccgactccaagggcaactaccactccatgaacttcggtctcttcagtgactggtcccagatggcctccgccagccagaaccccatgaacttcaacgctgtcgccccgactctgttcttcttcgctcccaagaacgtctgggttctcgcctaccagtggggcgccaacgccttctcctaccgtacctccaacgaccccgccaatgccaatggatggtcgtctgagcacccgctgttcaccggaaagatcgccaacagcggtaccggccccatcgaccagaccctgatcggtgacaaccagaacatgtacctgttcttcgccggtgataacggcaagatctaccggtccagcatgcccctcaacaacttccccggatccttcggcggtgcctccgaggtcatcctgagcgacaccaccgccaacctcttcgaggccgtccaggtctacaaggttgccggtgagaacaagtatctcatgatcgtcgaggccatgggtgcccacggccgctacttccgctccttcactgccaccagcctcaacggcaagtggaccctcaacgctggctccgagggtgctcccttcgccggcaaggccaacagcggtgctggctggaccaacgacatcagccacggtgacctcgtccgtaccaaccctgaccagaccatgaccgtcgacatgtgcaacctccagttcctgtaccagggccgtgaccccaacgccaaccccacctacaacgctctgccttaccgccccggtgttctcaccctgaagcactag

SEQ ID NO: 23 - protein, 331 aa, Penicillium oxalicum
MRSPISNLDLWSSFTVLLASAGTLASAACPVPSQGQYRWSSTGALAQPQHGWTSIKDFTNVVYNGKHLVYASVADSKGNYHSMNFGLFSDWSQMASASQNPMNFNAVAPTLFFFAPKNVWVLAYQWGANAFSYRTSNDPANANGWSSEHPLFTGKIANSGTGPIDQTLIGDNQNMYLFFAGDNGKIYRSSMPLNNFPGSFGGASEVILSDTTANLFEAVQVYKVAGENKYLMIVEAMGAHGRYFRSFTATSLNGKWTLNAGSEGAPFAGKANSGAGWTNDISHGDLVRTNPDQTMTVDMCNLQFLYQGRDPNANPTYNALPYRPGVLTLKH

SEQ ID NO: 24 - protein, 302 aa, Penicillium oxalicum
PVPSQGQYRWSSTGALAQPQHGWTSIKDFTNVVYNGKHLVYASVADSKGNYHSMNFGLFSDWSQMASASQNPMNFNAVAPTLFFFAPKNVWVLAYQWGANAFSYRTSNDPANANGWSSEHPLFTGKIANSGTGPIDQTLIGDNQNMYLFFAGDNGKIYRSSMPLNNFPGSFGGASEVILSDTTANLFEAVQVYKVAGENKYLMIVEAMGAHGRYFRSFTATSLNGKWTLNAGSEGAPFAGKANSGAGWTNDISHGDLVRTNPDQTMTVDMCNLQFLYQGRDPNANPTYNALPYRPGVLTLKH

SEQ ID NO: 25 - DNA, 1030 bp, Talaromyces pinophilus
  CDS (1)..(70)
  sig_peptide (1)..(48)
  mat_peptide (49)..(1027)
  CDS (123)..(1027)
atgcatttcctcgccgcgttgctcgcggttctgccacttgtatctgggtctccagtacccgagaaacgatgtaagttgtatccacctgaacagtgaaagctggacggtattgacaatcacagccggatgcgcacttccctctacgtacaagtggacatccactggcccgctggcaagccccaagtcgggtttggttgctctgagagactatagccatgtcatctacaacggccaacatctcgtatacggatcgaccgccaacacagctggcagctatggttccatgaactttggcctgttttcggactggtctgagatgtcatctgccagccaaaacacgatgagcactggcgccgtcgctcccacgatcttctactttgcaccaaagagtgtctggatccttgcctatcaatggggtccatatgcgttttcctacaggacttctaccgatccttccaatgccaatggctggtcatcgccacagcctcttttcacgggaactatttccggctccagtaccggtgtcatcgatcagacagttattggcgatagcgaaaacatgtatctcttctttgctggagataatggccatatttaccgtgctagcatgcccattggagactttcctggaagtttcggctcagcatcgacgattgtcctcagcgactcgactaacaacttgttcgaggcggtagaggtctacaccgtcgagggtcaaaatcaatacctcatgattgtcgaggcaattggtgccaatggacgttatttccgctccttcacagctagtagtctgggaggcacatggacggcgcaggcttcaaccgagtccaacccattcgctggcaaggctaacagtggcgccacctggaccaacgacatcagcagcggcgatttggtccgtactaatcccgatcagacacagacgatcgatgcctgcaatctacaattcctctatcaaggacgatccaccagctccggcggcgactacaaccttcttccttaccagcctggtctgttgacacttgcttag

SEQ ID NO: 26 - protein, 325 aa, Talaromyces pinophilus
MHFLAALLAVLPLVSGSPVPEKRSGCALPSTYKWTSTGPLASPKSGLVALRDYSHVIYNGQHLVYGSTANTAGSYGSMNFGLFSDWSEMSSASQNTMSTGAVAPTIFYFAPKSVWILAYQWGPYAFSYRTSTDPSNANGWSSPQPLFTGTISGSSTGVIDQTVIGDSENMYLFFAGDNGHIYRASMPIGDFPGSFGSASTIVLSDSTNNLFEAVEVYTVEGQNQYLMIVEAIGANGRYFRSFTASSLGGTWTAQASTESNPFAGKANSGATWTNDISSGDLVRTNPDQTQTIDACNLQFLYQGRSTSSGGDYNLLPYQPGLLTLA

SEQ ID NO: 27 - protein, 309 aa, Talaromyces pinophilus
SPVPEKRSGCALPSTYKWTSTGPLASPKSGLVALRDYSHVIYNGQHLVYGSTANTAGSYGSMNFGLFSDWSEMSSASQNTMSTGAVAPTIFYFAPKSVWILAYQWGPYAFSYRTSTDPSNANGWSSPQPLFTGTISGSSTGVIDQTVIGDSENMYLFFAGDNGHIYRASMPIGDFPGSFGSASTIVLSDSTNNLFEAVEVYTVEGQNQYLMIVEAIGANGRYFRSFTASSLGGTWTAQASTESNPFAGKANSGATWTNDISSGDLVRTNPDQTQTIDACNLQFLYQGRSTSSGGDYNLLPYQPGLLTLA

SEQ ID NO: 28 - DNA, 1425 bp, Streptomyces nitrosporeus
  CDS (1)..(1422)
  sig_peptide (1)..(108)
  mat_peptide (109)..(1422)
atgtacagaggaagtctcagccgcgggcgcacgcccgcggtgctcgccgccgcggtcgcggtcctggcggcgctggcggcgatgcttgtcgccaccccggcccaggcggccgccagcggcgccctgcgcggtgccggttcgggccggtgcgtcgacgtgacgggcggcgaacggaccgacggcactaccctccagctctacgactgctggggcgggaccaaccagcagtggacgtcgacggacagcggccagctgaccgtgtacggcgacaagtgcctggacgttccgggccacgccaccacacccggtaccagggtgcagatctggggctgctccggcggtgcgaaccagcagtggcgggtgaactccgacggcacggtcgtcggcgtggagtccgggctgtgcctggaggccgcgggcgccggtacggccaacggcacagcggtccagctctggacgtgcaacggcggcagcaaccagaagtggaccggtctgcccgcgacgccgccgacggacggcacgtgttcccttccgtcggcgtaccggtggacgtctacgggcgtgctggcgcagccggcgaacgggtgggccgcggtgaaggacttcaccaccgtgacccacaacggcaagcacctggtctacgcgtcgaacgtgtcggggtcgtcgtacggttcgatgatgttcagtcccttcacggactggccggacatggcgtcggccggccagacgggaatgagccaggccgcggtggcgcccacgctgttctacttcgcgcccaagaacatctgggtactggcgtaccagtggggcgcgtggcccttcatctaccgcacgtcgagcaaccccgccgaccccaacggctggtcctccccgcagccgctgttcaccgggagcatctccggatccgacaccggcccgatcgatcagaccctgatcgccgacggacagaacatgtacctgttcttcgccggtgacaacgggaagatctaccgggcgagcatgccgatcgggaacttcccgggcagcttcggctcgtcgtacacgacggtcatgagcgacacgaaggccaacctgttcgagggcgtccaggtctacaaggtcaaggaccggagccagtacctcatgatcgtcgaggcgatgggtgcgaacgggcgctacttccgctccttcacggcctccagcctgaacgggacgtggaccccgcaggccgccaccgagagcagccccttcgcgggcaaggccaacagcggtgccacctggaccaacgacatcagccacggcgacctggtccgcgacaaccccgaccagaccatgaccgtcgacccctgcaacctgcggttcctctaccagggcaaggcgcccgacgcgggcggcgagtacaaccggctgccgtggcggccgggggtcctcaccctgcggcgctga

SEQ ID NO: 29 - protein, 474 aa, Streptomyces nitrosporeus
MYRGSLSRGRTPAVLAAAVAVLAALAAMLVATPAQAAASGALRGAGSGRCVDVTGGERTDGTTLQLYDCWGGTNQQWTSTDSGQLTVYGDKCLDVPGHATTPGTRVQIWGCSGGANQQWRVNSDGTVVGVESGLCLEAAGAGTANGTAVQLWTCNGGSNQKWTGLPATPPTDGTCSLPSAYRWTSTGVLAQPANGWAAVKDFTTVTHNGKHLVYASNVSGSSYGSMMFSPFTDWPDMASAGQTGMSQAAVAPTLFYFAPKNIWVLAYQWGAWPFIYRTSSNPADPNGWSSPQPLFTGSISGSDTGPIDQTLIADGQNMYLFFAGDNGKIYRASMPIGNFPGSFGSSYTTVMSDTKANLFEGVQVYKVKDRSQYLMIVEAMGANGRYFRSFTASSLNGTWTPQAATESSPFAGKANSGATWTNDISHGDLVRDNPDQTMTVDPCNLRFLYQGKAPDAGGEYNRLPWRPGVLTLRR

SEQ ID NO: 30 - protein, 438 aa, Streptomyces nitrosporeus
AASGALRGAGSGRCVDVTGGERTDGTTLQLYDCWGGTNQQWTSTDSGQLTVYGDKCLDVPGHATTPGTRVQIWGCSGGANQQWRVNSDGTVVGVESGLCLEAAGAGTANGTAVQLWTCNGGSNQKWTGLPATPPTDGTCSLPSAYRWTSTGVLAQPANGWAAVKDFTTVTHNGKHLVYASNVSGSSYGSMMFSPFTDWPDMASAGQTGMSQAAVAPTLFYFAPKNIWVLAYQWGAWPFIYRTSSNPADPNGWSSPQPLFTGSISGSDTGPIDQTLIADGQNMYLFFAGDNGKIYRASMPIGNFPGSFGSSYTTVMSDTKANLFEGVQVYKVKDRSQYLMIVEAMGANGRYFRSFTASSLNGTWTPQAATESSPFAGKANSGATWTNDISHGDLVRDNPDQTMTVDPCNLRFLYQGKAPDAGGEYNRLPWRPGVLTLRR

SEQ ID NO: 31 - DNA, 1422 bp, Artificial Sequence
  Expression construct
  CDS (1)..(1419)
  sig_peptide (1)..(81)
  mat_peptide (82)..(1419)
atgaagaaaccgttggggaaaattgtcgcaagcaccgcactactcatttctgttgcttttagttcatcgatagcatcagcacatcatcatcaccatcatcctagggccgccagcggcgccctgcgcggtgccggttcgggccggtgcgtcgacgtgacgggcggcgaacggaccgacggcactaccctccagctctacgactgctggggcgggaccaaccagcagtggacgtcgacggacagcggccagctgaccgtgtacggcgacaagtgcctggacgttccgggccacgccaccacacccggtaccagggtgcagatctggggctgctccggcggtgcgaaccagcagtggcgggtgaactccgacggcacggtcgtcggcgtggagtccgggctgtgcctggaggccgcgggcgccggtacggccaacggcacagcggtccagctctggacgtgcaacggcggcagcaaccagaagtggaccggtctgcccgcgacgccgccgacggacggcacgtgttcccttccgtcggcgtaccggtggacgtctacgggcgtgctggcgcagccggcgaacgggtgggccgcggtgaaggacttcaccaccgtgacccacaacggcaagcacctggtctacgcgtcgaacgtgtcggggtcgtcgtacggttcgatgatgttcagtcccttcacggactggccggacatggcgtcggccggccagacgggaatgagccaggccgcggtggcgcccacgctgttctacttcgcgcccaagaacatctgggtactggcgtaccagtggggcgcgtggcccttcatctaccgcacgtcgagcaaccccgccgaccccaacggctggtcctccccgcagccgctgttcaccgggagcatctccggatccgacaccggcccgatcgatcagaccctgatcgccgacggacagaacatgtacctgttcttcgccggtgacaacgggaagatctaccgggcgagcatgccgatcgggaacttcccgggcagcttcggctcgtcgtacacgacggtcatgagcgacacgaaggccaacctgttcgagggcgtccaggtctacaaggtcaaggaccggagccagtacctcatgatcgtcgaggcgatgggtgcgaacgggcgctacttccgctccttcacggcctccagcctgaacgggacgtggaccccgcaggccgccaccgagagcagccccttcgcgggcaaggccaacagcggtgccacctggaccaacgacatcagccacggcgacctggtccgcgacaaccccgaccagaccatgaccgtcgacccctgcaacctgcggttcctctaccagggcaaggcgcccgacgcgggcggcgagtacaaccggctgccgtggcggccgggggtcctcaccctgcggcgctga

SEQ ID NO: 32 - protein, 473 aa, Artificial Sequence
  Synthetic Construct
MKKPLGKIVASTALLISVAFSSSIASAHHHHHHPRAASGALRGAGSGRCVDVTGGERTDGTTLQLYDCWGGTNQQWTSTDSGQLTVYGDKCLDVPGHATTPGTRVQIWGCSGGANQQWRVNSDGTVVGVESGLCLEAAGAGTANGTAVQLWTCNGGSNQKWTGLPATPPTDGTCSLPSAYRWTSTGVLAQPANGWAAVKDFTTVTHNGKHLVYASNVSGSSYGSMMFSPFTDWPDMASAGQTGMSQAAVAPTLFYFAPKNIWVLAYQWGAWPFIYRTSSNPADPNGWSSPQPLFTGSISGSDTGPIDQTLIADGQNMYLFFAGDNGKIYRASMPIGNFPGSFGSSYTTVMSDTKANLFEGVQVYKVKDRSQYLMIVEAMGANGRYFRSFTASSLNGTWTPQAATESSPFAGKANSGATWTNDISHGDLVRDNPDQTMTVDPCNLRFLYQGKAPDAGGEYNRLPWRPGVLTLRR

SEQ ID NO: 33 - protein, 446 aa, Artificial Sequence
  Mature sequence with His-tag
HHHHHHPRAASGALRGAGSGRCVDVTGGERTDGTTLQLYDCWGGTNQQWTSTDSGQLTVYGDKCLDVPGHATTPGTRVQIWGCSGGANQQWRVNSDGTVVGVESGLCLEAAGAGTANGTAVQLWTCNGGSNQKWTGLPATPPTDGTCSLPSAYRWTSTGVLAQPANGWAAVKDFTTVTHNGKHLVYASNVSGSSYGSMMFSPFTDWPDMASAGQTGMSQAAVAPTLFYFAPKNIWVLAYQWGAWPFIYRTSSNPADPNGWSSPQPLFTGSISGSDTGPIDQTLIADGQNMYLFFAGDNGKIYRASMPIGNFPGSFGSSYTTVMSDTKANLFEGVQVYKVKDRSQYLMIVEAMGANGRYFRSFTASSLNGTWTPQAATESSPFAGKANSGATWTNDISHGDLVRDNPDQTMTVDPCNLRFLYQGKAPDAGGEYNRLPWRPGVLTLRR

SEQ ID NO: 34 - DNA, 1425 bp, Streptomyces beijiangensis
  CDS (1)..(1422)
  sig_peptide (1)..(108)
  mat_peptide (109)..(1422)
atgagcagacgaactttcagtcgcaggcatccatctgctgtgctcgccgccgtgatcgcggctctgggagcattggcggcgatgctcgtcgccaccccggctcaggcggctgccggcggcgccctgcgccaggccgcttccggccggtgcctcgatgtgccgggcgccgtccagaccgacggtacgtccgtgcagatctatgactgctggagtggaaccaaccagcagtggacgtcgacggacgccaaccagctcaccgtgtacggcaacaagtgcctggatgtccccggtcacgccaccacggccgggacccgggtgcagatatggagctgttccggcggtgcgaaccagcagtggagggtgaactccgacggcacggtcaccggcgtggagtcagggctgtgcctggaggccgcgggcgccgccacggccaacggaacggcggtgcagctgggaacgtgcaaccagggaagcaaccagaaatggagcggtctgaccgggacgccgccgacggacggctcgtgttccctgccgtcgacgtaccgctggtcgtcgacgggtgtgctggcgcagcctgcgaacgggtgggcggcggtgaaggacttcaccaccgtgacctacaacggcaagcacctggtctacgcctcgaacgtgtcgggatcgtcgtacggctcgatgatgttcagtcccttcacgaactggtcggacatggcgtcggccggccagagcgggatgagccaggccgcggtggcacccacgctgttctacttcgcgcccaagaacatctgggtgctggcgtaccagtggggcgcgtcgcccttcgtctaccgcacgtcgagcgaccccaccaaccccaacggctggtcatcaccgcagccactgttcaccgggagcatctccggctccgacaccggaccgatcgaccagaccctgatcgccgacggccagaacatgtacctgttcttcgccggcgacaacggcaagatctaccgggcgagcatgccgatcgggaacttcccgggcaacttcggctcgtcgtacacgacggtcatgagcgacaccaaggccaacctgttcgagggcgtacaggtctacaaggtccagggccagaaccagtacctcatgatcgtcgaggcgatgggtgcgaacgggcgctacttccgctccttcaccgcctccagtctgaacgggtcatgggccccgcaggcggcaaccgagagcaaccccttcgcgggcaaggccaacagcggtgccacctggaccaacgacatcagccacggggacctggtccggggcaacccggatcagaccatgacgatcgatccttgcaacctgcaactcctctaccaggggaaatctcccaccgcgggcggcccctacgaccaactgccgtggcggccaggcgtcctctcccttcagcgctga

SEQ ID NO: 35 - protein, 474 aa, Streptomyces beijiangensis
MSRRTFSRRHPSAVLAAVIAALGALAAMLVATPAQAAAGGALRQAASGRCLDVPGAVQTDGTSVQIYDCWSGTNQQWTSTDANQLTVYGNKCLDVPGHATTAGTRVQIWSCSGGANQQWRVNSDGTVTGVESGLCLEAAGAATANGTAVQLGTCNQGSNQKWSGLTGTPPTDGSCSLPSTYRWSSTGVLAQPANGWAAVKDFTTVTYNGKHLVYASNVSGSSYGSMMFSPFTNWSDMASAGQSGMSQAAVAPTLFYFAPKNIWVLAYQWGASPFVYRTSSDPTNPNGWSSPQPLFTGSISGSDTGPIDQTLIADGQNMYLFFAGDNGKIYRASMPIGNFPGNFGSSYTTVMSDTKANLFEGVQVYKVQGQNQYLMIVEAMGANGRYFRSFTASSLNGSWAPQAATESNPFAGKANSGATWTNDISHGDLVRGNPDQTMTIDPCNLQLLYQGKSPTAGGPYDQLPWRPGVLSLQR

SEQ ID NO: 36 - protein, 438 aa, Artificial Sequence
  Mature sequence with His-tag
AAGGALRQAASGRCLDVPGAVQTDGTSVQIYDCWSGTNQQWTSTDANQLTVYGNKCLDVPGHATTAGTRVQIWSCSGGANQQWRVNSDGTVTGVESGLCLEAAGAATANGTAVQLGTCNQGSNQKWSGLTGTPPTDGSCSLPSTYRWSSTGVLAQPANGWAAVKDFTTVTYNGKHLVYASNVSGSSYGSMMFSPFTNWSDMASAGQSGMSQAAVAPTLFYFAPKNIWVLAYQWGASPFVYRTSSDPTNPNGWSSPQPLFTGSISGSDTGPIDQTLIADGQNMYLFFAGDNGKIYRASMPIGNFPGNFGSSYTTVMSDTKANLFEGVQVYKVQGQNQYLMIVEAMGANGRYFRSFTASSLNGSWAPQAATESNPFAGKANSGATWTNDISHGDLVRGNPDQTMTIDPCNLQLLYQGKSPTAGGPYDQLPWRPGVLSLQR

SEQ ID NO: 37 - DNA, 1422 bp, Artificial Sequence
  Expression construct
  CDS (1)..(1419)
  sig_peptide (1)..(81)
  mat_peptide (82)..(1419)
atgaagaaaccgttggggaaaattgtcgcaagcaccgcactactcatttctgttgcttttagttcatcgatagcatcagcacatcatcatcaccatcatcctagggctgccggcggcgccctgcgccaggccgcttccggccggtgcctcgatgtgccgggcgccgtccagaccgacggtacgtccgtgcagatctatgactgctggagtggaaccaaccagcagtggacgtcgacggacgccaaccagctcaccgtgtacggcaacaagtgcctggatgtccccggtcacgccaccacggccgggacccgggtgcagatatggagctgttccggcggtgcgaaccagcagtggagggtgaactccgacggcacggtcaccggcgtggagtcagggctgtgcctggaggccgcgggcgccgccacggccaacggaacggcggtgcagctgggaacgtgcaaccagggaagcaaccagaaatggagcggtctgaccgggacgccgccgacggacggctcgtgttccctgccgtcgacgtaccgctggtcgtcgacgggtgtgctggcgcagcctgcgaacgggtgggcggcggtgaaggacttcaccaccgtgacctacaacggcaagcacctggtctacgcctcgaacgtgtcgggatcgtcgtacggctcgatgatgttcagtcccttcacgaactggtcggacatggcgtcggccggccagagcgggatgagccaggccgcggtggcacccacgctgttctacttcgcgcccaagaacatctgggtgctggcgtaccagtggggcgcgtcgcccttcgtctaccgcacgtcgagcgaccccaccaaccccaacggctggtcatcaccgcagccactgttcaccgggagcatctccggctccgacaccggaccgatcgaccagaccctgatcgccgacggccagaacatgtacctgttcttcgccggcgacaacggcaagatctaccgggcgagcatgccgatcgggaacttcccgggcaacttcggctcgtcgtacacgacggtcatgagcgacaccaaggccaacctgttcgagggcgtacaggtctacaaggtccagggccagaaccagtacctcatgatcgtcgaggcgatgggtgcgaacgggcgctacttccgctccttcaccgcctccagtctgaacgggtcatgggccccgcaggcggcaaccgagagcaaccccttcgcgggcaaggccaacagcggtgccacctggaccaacgacatcagccacggggacctggtccggggcaacccggatcagaccatgacgatcgatccttgcaacctgcaactcctctaccaggggaaatctcccaccgcgggcggcccctacgaccaactgccgtggcggccaggcgtcctctcccttcagcgctga

SEQ ID NO: 38 - protein, 473 aa, Artificial Sequence
  Synthetic Construct
MKKPLGKIVASTALLISVAFSSSIASAHHHHHHPRAAGGALRQAASGRCLDVPGAVQTDGTSVQIYDCWSGTNQQWTSTDANQLTVYGNKCLDVPGHATTAGTRVQIWSCSGGANQQWRVNSDGTVTGVESGLCLEAAGAATANGTAVQLGTCNQGSNQKWSGLTGTPPTDGSCSLPSTYRWSSTGVLAQPANGWAAVKDFTTVTYNGKHLVYASNVSGSSYGSMMFSPFTNWSDMASAGQSGMSQAAVAPTLFYFAPKNIWVLAYQWGASPFVYRTSSDPTNPNGWSSPQPLFTGSISGSDTGPIDQTLIADGQNMYLFFAGDNGKIYRASMPIGNFPGNFGSSYTTVMSDTKANLFEGVQVYKVQGQNQYLMIVEAMGANGRYFRSFTASSLNGSWAPQAATESNPFAGKANSGATWTNDISHGDLVRGNPDQTMTIDPCNLQLLYQGKSPTAGGPYDQLPWRPGVLSLQR

SEQ ID NO: 39 - protein, 446 aa, Artificial Sequence
  Mature sequence with His-tag
HHHHHHPRAAGGALRQAASGRCLDVPGAVQTDGTSVQIYDCWSGTNQQWTSTDANQLTVYGNKCLDVPGHATTAGTRVQIWSCSGGANQQWRVNSDGTVTGVESGLCLEAAGAATANGTAVQLGTCNQGSNQKWSGLTGTPPTDGSCSLPSTYRWSSTGVLAQPANGWAAVKDFTTVTYNGKHLVYASNVSGSSYGSMMFSPFTNWSDMASAGQSGMSQAAVAPTLFYFAPKNIWVLAYQWGASPFVYRTSSDPTNPNGWSSPQPLFTGSISGSDTGPIDQTLIADGQNMYLFFAGDNGKIYRASMPIGNFPGNFGSSYTTVMSDTKANLFEGVQVYKVQGQNQYLMIVEAMGANGRYFRSFTASSLNGSWAPQAATESNPFAGKANSGATWTNDISHGDLVRGNPDQTMTIDPCNLQLLYQGKSPTAGGPYDQLPWRPGVLSLQR

SEQ ID NO: 40 - DNA, 1011 bp, Aspergillus clavatus
  CDS (1)..(1008)
  sig_peptide (1)..(54)
  mat_peptide (55)..(1008)
atgcggtcgatcctcttcctagtcacttccaccctcgctgctgctgctgctgctgcttccttacccagaagcttcaaatggagctccagcgccgccctcgtgggccctaagaacgatggccgccatatcgagggcatcaaggatccctccatcgtcgaggtggacggcacctaccacgtcttcgctagcaccgcccaggcctccggctacaacctggtgtatcttagcttcaccgacttcaataaggctcacctggctccattccactacctggaccagacccggatcggcaaaggctaccgcgccgcgccacaggtcttctacttcaagccccacaaactgtggtatctggtctaccagaacggcaacgcagcctattccaccaaccccgacatcagcaacccggccggctggacctctccgcagaacttcttcagcggcacacccagcatcatcacccacaacatgggccgcggcgcctgggtggacatgtggaccatctgcgacacacgcaactgctacctcttctcctcagacgacaacggacacctctaccgctcccagacatccctggccgacttcccccacggcatgggcaacactgctattgccctcgcagaccgcaacaagttcagcctcttcgaagcatccaatgtctaccacaccggggatggaagctatctgctcatcgtcgaggcgatcggcaacgacggccagcggtacttccgctcctggactgcgagcagcttggccggccagtggaagcccctggcggataccgagtcgaaccccttcgcgcgctcgaacaatgttgccttcgctaatggccatgcctggacgaagagcatcagccacggcgagatgatccgaacccagacggatcagactatgactatcagcccgtgcaagctgcggtatctgtaccagggggtggatcctgcggctaagggggattataatgcgcttccgtggaagctgggcttgctgacccagacgaactcggcttgttaa

SEQ ID NO: 41 - protein, 336 aa, Aspergillus clavatus
MRSILFLVTSTLAAAAAAASLPRSFKWSSSAALVGPKNDGRHIEGIKDPSIVEVDGTYHVFASTAQASGYNLVYLSFTDFNKAHLAPFHYLDQTRIGKGYRAAPQVFYFKPHKLWYLVYQNGNAAYSTNPDISNPAGWTSPQNFFSGTPSIITHNMGRGAWVDMWTICDTRNCYLFSSDDNGHLYRSQTSLADFPHGMGNTAIALADRNKFSLFEASNVYHTGDGSYLLIVEAIGNDGQRYFRSWTASSLAGQWKPLADTESNPFARSNNVAFANGHAWTKSISHGEMIRTQTDQTMTISPCKLRYLYQGVDPAAKGDYNALPWKLGLLTQTNSAC

SEQ ID NO: 42 - protein, 318 aa, Aspergillus clavatus
ASLPRSFKWSSSAALVGPKNDGRHIEGIKDPSIVEVDGTYHVFASTAQASGYNLVYLSFTDFNKAHLAPFHYLDQTRIGKGYRAAPQVFYFKPHKLWYLVYQNGNAAYSTNPDISNPAGWTSPQNFFSGTPSIITHNMGRGAWVDMWTICDTRNCYLFSSDDNGHLYRSQTSLADFPHGMGNTAIALADRNKFSLFEASNVYHTGDGSYLLIVEAIGNDGQRYFRSWTASSLAGQWKPLADTESNPFARSNNVAFANGHAWTKSISHGEMIRTQTDQTMTISPCKLRYLYQGVDPAAKGDYNALPWKLGLLTQTNSAC

SEQ ID NO: 43 - DNA, 1035 bp, Artificial Sequence
  Expression construct
  CDS (1)..(1032)
  sig_peptide (1)..(54)
  mat_peptide (55)..(1032)
atgcggtcgatcctcttcctagtcacttccaccctcgctgctgctgctgctgctgcttccttacccagaagcttcaaatggagctccagcgccgccctcgtgggccctaagaacgatggccgccatatcgagggcatcaaggatccctccatcgtcgaggtggacggcacctaccacgtcttcgctagcaccgcccaggcctccggctacaacctggtgtatcttagcttcaccgacttcaataaggctcacctggctccattccactacctggaccagacccggatcggcaaaggctaccgcgccgcgccacaggtcttctacttcaagccccacaaactgtggtatctggtctaccagaacggcaacgcagcctattccaccaaccccgacatcagcaacccggccggctggacctctccgcagaacttcttcagcggcacacccagcatcatcacccacaacatgggccgcggcgcctgggtggacatgtggaccatctgcgacacacgcaactgctacctcttctcctcagacgacaacggacacctctaccgctcccagacatccctggccgacttcccccacggcatgggcaacactgctattgccctcgcagaccgcaacaagttcagcctcttcgaagcatccaatgtctaccacaccggggatggaagctatctgctcatcgtcgaggcgatcggcaacgacggccagcggtacttccgctcctggactgcgagcagcttggccggccagtggaagcccctggcggataccgagtcgaaccccttcgcgcgctcgaacaatgttgccttcgctaatggccatgcctggacgaagagcatcagccacggcgagatgatccgaacccagacggatcagactatgactatcagcccgtgcaagctgcggtatctgtaccagggggtggatcctgcggctaagggggattataatgcgcttccgtggaagctgggcttgctgacccagacgaactcggcttgtcgacatcaccatcaccatcacccatga

SEQ ID NO: 44 - protein, 344 aa, Artificial Sequence
  Synthetic Construct
MRSILFLVTSTLAAAAAAASLPRSFKWSSSAALVGPKNDGRHIEGIKDPSIVEVDGTYHVFASTAQASGYNLVYLSFTDFNKAHLAPFHYLDQTRIGKGYRAAPQVFYFKPHKLWYLVYQNGNAAYSTNPDISNPAGWTSPQNFFSGTPSIITHNMGRGAWVDMWTICDTRNCYLFSSDDNGHLYRSQTSLADFPHGMGNTAIALADRNKFSLFEASNVYHTGDGSYLLIVEAIGNDGQRYFRSWTASSLAGQWKPLADTESNPFARSNNVAFANGHAWTKSISHGEMIRTQTDQTMTISPCKLRYLYQGVDPAAKGDYNALPWKLGLLTQTNSACRHHHHHHP

SEQ ID NO: 45 - protein, 326 aa, Artificial Sequence
  Mature sequence with His-tag
ASLPRSFKWSSSAALVGPKNDGRHIEGIKDPSIVEVDGTYHVFASTAQASGYNLVYLSFTDFNKAHLAPFHYLDQTRIGKGYRAAPQVFYFKPHKLWYLVYQNGNAAYSTNPDISNPAGWTSPQNFFSGTPSIITHNMGRGAWVDMWTICDTRNCYLFSSDDNGHLYRSQTSLADFPHGMGNTAIALADRNKFSLFEASNVYHTGDGSYLLIVEAIGNDGQRYFRSWTASSLAGQWKPLADTESNPFARSNNVAFANGHAWTKSISHGEMIRTQTDQTMTISPCKLRYLYQGVDPAAKGDYNALPWKLGLLTQTNSACRHHHHHHP

SEQ ID NO: 46 - DNA, 984 bp, Aspergillus wentii
  CDS (1)..(981)
  sig_peptide (1)..(75)
  mat_peptide (76)..(981)
atgaaattcttcaaggcgcaagctggtgtgccatctggcatattcttgctctctctggcaccagttgtcattgccgactgcgctcttccgtcaacctatagctggacatcaactggctctctggcagatccaaagtctggatggacggcgctcaaggattttaccaatgtggtctccaacaacaaacatatcgtctatgcatcaaccactgacgccagtggaaactacggctcgatgaattttgcctccttttcagactggtctgacatggcatctgcaagtcaagccgcgacgagctttacggcagttgcgcccactttgctctacttccagccaaagagcatctgggtgctggcctaccaatggggctcgagtacgtttacctaccgaacgtcaagcgatcctaccaatgccaatggatggtcatccgagaaagctcttttctctggaaagatcaccggctcggacactggcgccattgatcagacccttatcggtgacgccacgaatatgtatcttttctttgcgggagataacggcaagatctatcggtcgagcatgccaatcgccaacttccctggagacttcggaacggcgtcagaagtcgttcttagtgacagccggaacaatctcttcgaagcagtccaagtttacaccgtcgaagggcaaaaccagtatctgatgatcgtcgaggcaattggaacaaacggccgttatttccgttcattcaccgccagcagtctcgacggttcgtggacagagcaggcagccagcgagaacaatcccttcgctggaaaggccaacagcggtgcgacctggaccaacgacatcagtcacggcgatttggttcgcaataaccctgaccaaacaatgactatcgacccatgcaacctgcaattcctctaccaggggcgcgatgcgagtgccggtggtaactacaataccctgccgtggaggccaggtgtactgactctgaagcactaa

SEQ ID NO: 47 - protein, 327 aa, Aspergillus wentii
MKFFKAQAGVPSGIFLLSLAPVVIADCALPSTYSWTSTGSLADPKSGWTALKDFTNVVSNNKHIVYASTTDASGNYGSMNFASFSDWSDMASASQAATSFTAVAPTLLYFQPKSIWVLAYQWGSSTFTYRTSSDPTNANGWSSEKALFSGKITGSDTGAIDQTLIGDATNMYLFFAGDNGKIYRSSMPIANFPGDFGTASEVVLSDSRNNLFEAVQVYTVEGQNQYLMIVEAIGTNGRYFRSFTASSLDGSWTEQAASENNPFAGKANSGATWTNDISHGDLVRNNPDQTMTIDPCNLQFLYQGRDASAGGNYNTLPWRPGVLTLKH

SEQ ID NO: 48 - protein, 302 aa, Aspergillus wentii
DCALPSTYSWTSTGSLADPKSGWTALKDFTNVVSNNKHIVYASTTDASGNYGSMNFASFSDWSDMASASQAATSFTAVAPTLLYFQPKSIWVLAYQWGSSTFTYRTSSDPTNANGWSSEKALFSGKITGSDTGAIDQTLIGDATNMYLFFAGDNGKIYRSSMPIANFPGDFGTASEVVLSDSRNNLFEAVQVYTVEGQNQYLMIVEAIGTNGRYFRSFTASSLDGSWTEQAASENNPFAGKANSGATWTNDISHGDLVRNNPDQTMTIDPCNLQFLYQGRDASAGGNYNTLPWRPGVLTLKH

SEQ ID NO: 49 - DNA, 1011 bp, Artificial Sequence
  Expression construct
  CDS (1)..(1008)
  sig_peptide (1)..(75)
  mat_peptide (76)..(1008)
atgaaattcttcaaggcgcaagctggtgtgccatctggcatattcttgctctctctggcaccagttgtcattgccgactgcgctcttccgtcaacctatagctggacatcaactggctctctggcagatccaaagtctggatggacggcgctcaaggattttaccaatgtggtctccaacaacaaacatatcgtctatgcatcaaccactgacgccagtggaaactacggctcgatgaattttgcctccttttcagactggtctgacatggcatctgcaagtcaagccgcgacgagctttacggcagttgcgcccactttgctctacttccagccaaagagcatctgggtgctggcctaccaatggggctcgagtacgtttacctaccgaacgtcaagcgatcctaccaatgccaatggatggtcatccgagaaagctcttttctctggaaagatcaccggctcggacactggcgccattgatcagacccttatcggtgacgccacgaatatgtatcttttctttgcgggagataacggcaagatctatcggtcgagcatgccaatcgccaacttccctggagacttcggaacggcgtcagaagtcgttcttagtgacagccggaacaatctcttcgaagcagtccaagtttacaccgtcgaagggcaaaaccagtatctgatgatcgtcgaggcaattggaacaaacggccgttatttccgttcattcaccgccagcagtctcgacggttcgtggacagagcaggcagccagcgagaacaatcccttcgctggaaaggccaacagcggtgcgacctggaccaacgacatcagtcacggcgatttggttcgcaataaccctgaccaaacaatgactatcgacccatgcaacctgcaattcctctaccaggggcgcgatgcgagtgccggtggtaactacaataccctgccgtggaggccaggtgtactgactctgaagcacacgcgtgcgcatcaccatcaccatcactaa

SEQ ID NO: 50 - protein, 336 aa, Artificial Sequence
  Synthetic Construct
MKFFKAQAGVPSGIFLLSLAPVVIADCALPSTYSWTSTGSLADPKSGWTALKDFTNVVSNNKHIVYASTTDASGNYGSMNFASFSDWSDMASASQAATSFTAVAPTLLYFQPKSIWVLAYQWGSSTFTYRTSSDPTNANGWSSEKALFSGKITGSDTGAIDQTLIGDATNMYLFFAGDNGKIYRSSMPIANFPGDFGTASEVVLSDSRNNLFEAVQVYTVEGQNQYLMIVEAIGTNGRYFRSFTASSLDGSWTEQAASENNPFAGKANSGATWTNDISHGDLVRNNPDQTMTIDPCNLQFLYQGRDASAGGNYNTLPWRPGVLTLKHTRAHHHHHH

SEQ ID NO: 51 - protein, 311 aa, Artificial Sequence
  Mature sequence with His-tag
DCALPSTYSWTSTGSLADPKSGWTALKDFTNVVSNNKHIVYASTTDASGNYGSMNFASFSDWSDMASASQAATSFTAVAPTLLYFQPKSIWVLAYQWGSSTFTYRTSSDPTNANGWSSEKALFSGKITGSDTGAIDQTLIGDATNMYLFFAGDNGKIYRSSMPIANFPGDFGTASEVVLSDSRNNLFEAVQVYTVEGQNQYLMIVEAIGTNGRYFRSFTASSLDGSWTEQAASENNPFAGKANSGATWTNDISHGDLVRNNPDQTMTIDPCNLQFLYQGRDASAGGNYNTLPWRPGVLTLKHTRAHHHHHH

SEQ ID NO: 52 - DNA, 1411 bp, Acrophialophora fusispora
  CDS (1)..(318)
  sig_peptide (1)..(72)
  mat_peptide (73)..(1408)
  CDS (470)..(1298)
  CDS (1392)..(1408)
atgaagttctccaaatcggatctcggcgctgccgtcgccttcctggcttcggccgtccctctcgctgaagccgcgtgctccttgccgtccagctaccgctgggcaagcaccgggccattggccaaccccaagtcaggctggtacagtctcaaggactttactcatgtcccttacaacggcaagcacttggtctatgcgtcaaactatgccggatccgcctacggctccatgaacttcggcctcttctccaactggtccgacatggcctcggcgagtcaaaactctatgaatgcggccgccgtcgcacccaccctgtttgtaagtcagacctttgccgctttgctctatccttaaagccttaaggggttgtcattcctctggaccctgtttccgttaaactgctcggacaaacaacccccttccccccaactctccttccccgaaaaacacatgactgacagctgggcagtactttgcacctaagaatatctgggtacttgcatcgcagtggggagctactcccttcttctaccgcacgtcgaccgaccctacgaatcccaacagctggtcgtcgaaccagccgctgttcaccggctccatctcggactcatccactgggcccatcgaccagacgctcattggtgatgccaactacatgtatctcttctttgcgggcgacaacggcaagatttaccgctctcggatgcccatcggaaacttcccgggcagctttggctcatcctacgaagtcatcctgagcggctcgaggaacgatttcttcgaggcggtccaggtctacaccgtgacaggccaaagctcgccgctgtacctcatgatcatcgagagcatcggtagcagaggccggtacttccgctcctacacggccaccaacctcgggggctcgtggtctccgcaggccacgagcgagagctcgccgtttgccggggccgcgaacagcggcgcgacctggaccaacgacatcagccacggcgacctgatccgtagcggtcccgaccagactatgcctatcgacccgtgcaacctgcagctgctgtaccagggcctggtcggcaccaactccgactacaacaagctgccctaccggcccggcctcctgacgctgcagaaccctgtgggcggcggtggcactccgaccacgaccacgagcaagccgcccgcgacgacgacgtccaccggcggtggtggcaccgctcctcagtatgctcagtgcggcggtcagggatacaccggcccgacggtgtgcgccagcccgtacaagtgcacctactctaacccttgtaagtttttctgaaattctgttttcttttctctttgtatctcttcctttttcatgattacattggattgttgctgacgatatctccacatagggtattcccagtgcctgtaa

SEQ ID NO: 53 - protein, 388 aa, Acrophialophora fusispora
MKFSKSDLGAAVAFLASAVPLAEAACSLPSSYRWASTGPLANPKSGWYSLKDFTHVPYNGKHLVYASNYAGSAYGSMNFGLFSNWSDMASASQNSMNAAAVAPTLFYFAPKNIWVLASQWGATPFFYRTSTDPTNPNSWSSNQPLFTGSISDSSTGPIDQTLIGDANYMYLFFAGDNGKIYRSRMPIGNFPGSFGSSYEVILSGSRNDFFEAVQVYTVTGQSSPLYLMIIESIGSRGRYFRSYTATNLGGSWSPQATSESSPFAGAANSGATWTNDISHGDLIRSGPDQTMPIDPCNLQLLYQGLVGTNSDYNKLPYRPGLLTLQNPVGGGGTPTTTTSKPPATTTSTGGGGTAPQYAQCGGQGYTGPTVCASPYKCTYSNPWYSQCL

SEQ ID NO: 54 - protein, 364 aa, Acrophialophora fusispora
ACSLPSSYRWASTGPLANPKSGWYSLKDFTHVPYNGKHLVYASNYAGSAYGSMNFGLFSNWSDMASASQNSMNAAAVAPTLFYFAPKNIWVLASQWGATPFFYRTSTDPTNPNSWSSNQPLFTGSISDSSTGPIDQTLIGDANYMYLFFAGDNGKIYRSRMPIGNFPGSFGSSYEVILSGSRNDFFEAVQVYTVTGQSSPLYLMIIESIGSRGRYFRSYTATNLGGSWSPQATSESSPFAGAANSGATWTNDISHGDLIRSGPDQTMPIDPCNLQLLYQGLVGTNSDYNKLPYRPGLLTLQNPVGGGGTPTTTTSKPPATTTSTGGGGTAPQYAQCGGQGYTGPTVCASPYKCTYSNPWYSQCL

SEQ ID NO: 55 - DNA, 1438 bp, Artificial Sequence
  Expression construct
  CDS (1)..(318)
  sig_peptide (1)..(72)
  mat_peptide (73)..(1438)
  CDS (470)..(1298)
  CDS (1392)..(1435)
atgaagttctccaaatcggatctcggcgctgccgtcgccttcctggcttcggccgtccctctcgctgaagccgcgtgctccttgccgtccagctaccgctgggcaagcaccgggccattggccaaccccaagtcaggctggtacagtctcaaggactttactcatgtcccttacaacggcaagcacttggtctatgcgtcaaactatgccggatccgcctacggctccatgaacttcggcctcttctccaactggtccgacatggcctcggcgagtcaaaactctatgaatgcggccgccgtcgcacccaccctgtttgtaagtcagacctttgccgctttgctctatccttaaagccttaaggggttgtcattcctctggaccctgtttccgttaaactgctcggacaaacaacccccttccccccaactctccttccccgaaaaacacatgactgacagctgggcagtactttgcacctaagaatatctgggtacttgcatcgcagtggggagctactcccttcttctaccgcacgtcgaccgaccctacgaatcccaacagctggtcgtcgaaccagccgctgttcaccggctccatctcggactcatccactgggcccatcgaccagacgctcattggtgatgccaactacatgtatctcttctttgcgggcgacaacggcaagatttaccgctctcggatgcccatcggaaacttcccgggcagctttggctcatcctacgaagtcatcctgagcggctcgaggaacgatttcttcgaggcggtccaggtctacaccgtgacaggccaaagctcgccgctgtacctcatgatcatcgagagcatcggtagcagaggccggtacttccgctcctacacggccaccaacctcgggggctcgtggtctccgcaggccacgagcgagagctcgccgtttgccggggccgcgaacagcggcgcgacctggaccaacgacatcagccacggcgacctgatccgtagcggtcccgaccagactatgcctatcgacccgtgcaacctgcagctgctgtaccagggcctggtcggcaccaactccgactacaacaagctgccctaccggcccggcctcctgacgctgcagaaccctgtgggcggcggtggcactccgaccacgaccacgagcaagccgcccgcgacgacgacgtccaccggcggtggtggcaccgctcctcagtatgctcagtgcggcggtcagggatacaccggcccgacggtgtgcgccagcccgtacaagtgcacctactctaacccttgtaagtttttctgaaattctgttttcttttctctttgtatctcttcctttttcatgattacattggattgttgctgacgatatctccacatagggtattcccagtgcctgacgcgtgcgcatcaccatcaccatcactaa

SEQ ID NO: 56 - protein, 397 aa, Artificial Sequence
  Synthetic Construct
MKFSKSDLGAAVAFLASAVPLAEAACSLPSSYRWASTGPLANPKSGWYSLKDFTHVPYNGKHLVYASNYAGSAYGSMNFGLFSNWSDMASASQNSMNAAAVAPTLFYFAPKNIWVLASQWGATPFFYRTSTDPTNPNSWSSNQPLFTGSISDSSTGPIDQTLIGDANYMYLFFAGDNGKIYRSRMPIGNFPGSFGSSYEVILSGSRNDFFEAVQVYTVTGQSSPLYLMIIESIGSRGRYFRSYTATNLGGSWSPQATSESSPFAGAANSGATWTNDISHGDLIRSGPDQTMPIDPCNLQLLYQGLVGTNSDYNKLPYRPGLLTLQNPVGGGGTPTTTTSKPPATTTSTGGGGTAPQYAQCGGQGYTGPTVCASPYKCTYSNPWYSQCLTRAHHHHHH

SEQ ID NO: 57 - protein, 373 aa, Artificial Sequence
  Mature sequence with His-tag
ACSLPSSYRWASTGPLANPKSGWYSLKDFTHVPYNGKHLVYASNYAGSAYGSMNFGLFSNWSDMASASQNSMNAAAVAPTLFYFAPKNIWVLASQWGATPFFYRTSTDPTNPNSWSSNQPLFTGSISDSSTGPIDQTLIGDANYMYLFFAGDNGKIYRSRMPIGNFPGSFGSSYEVILSGSRNDFFEAVQVYTVTGQSSPLYLMIIESIGSRGRYFRSYTATNLGGSWSPQATSESSPFAGAANSGATWTNDISHGDLIRSGPDQTMPIDPCNLQLLYQGLVGTNSDYNKLPYRPGLLTLQNPVGGGGTPTTTTSKPPATTTSTGGGGTAPQYAQCGGQGYTGPTVCASPYKCTYSNPWYSQCLTRAHHHHHH

SEQ ID NO: 58 - DNA, 1404 bp, Streptosporangium sp-60756
  CDS (1)..(1401)
  sig_peptide (1)..(93)
  mat_peptide (94)..(1401)
atgaaaatcccccgtctccggctctggctctccgccggggtcgccgccgcggtcggcgtggtcggcacggtcggcgcggtgaccgcaccggccgccggcgccgccgccggatgccgcgtggactacacggtgagcaaccagtggccgggcggcttcggcgcgaacgtgaacatcaccaacctcggcgaccccatcaacggctggcgcctgacctggtcgttccccgcggggcagaccatcacccagctgtggagcggctcccacacccagtccggctcccaggtcaccgtgaccaacgtggactacaacgccggcctccccaccgggggcagcgcgaacttcgggttcaacggctccttcaacggcagcaacccggcaccgacgagcttcgccctcaacggtgtgacctgcaccggcggcgtgaccgcttcgcccagcccgtccaccagcccctcgaccggcccgtcgccgtcgtccacgccgacgtcgcccggcacctgcgctcttccgtcgacgtaccgctggacgtcgacgggcccgctggcgaacccgaagtcggggtgggtctcgctcaaggacttcaccaacgtcgtccacaacggcaagcacctcgtctacgccacgacgcacgacacggggacgagctggggctcgatgaacttcagccccttcacgaactggtccgacatggcctcggccggccagaacaagatgaacttctccaccgtcgcgcccacgctcttctacttcgccccgaagaacatctgggtgctggcctaccagtggggcgggaccgccttctcctaccggacctccagtgaccccaccaacgccaacggctggtcggcgcagcagaccctcttcaccggaagcatctccggctccggaaccgggcccatcgaccagacgctcatcggcgacggcaccaacatgtacctgttcttcgccggggacaacggcaagatctaccgggccagcatgccgatcgggaacttcccgggcagcttcggctcgaactacacgacgatcatgagcgacacgacgaacaacctgttcgaaggggtcgaggtctacaagctccaggggcagaacaagtacctcatgctcgtcgaggcgatcggctcgcagggtcgctacttccgctcgttcacggccaccagcctggacggcacatggacaccccaggccgcgaccgagggcaaccccttcgccggcaaggccaacagcggcgccacctggaccaacgacatcagccacggcgatctggtccgcagcaaccccgaccagaccaagaccgtcgacccctgcaacctgcaactgctctaccagggccgcagccccaactccggtggcgactacggcctgctgccctaccggccgggggtgctgacactgcagcgctga

SEQ ID NO: 59 - protein, 467 aa, Streptosporangium sp-60756
MKIPRLRLWLSAGVAAAVGVVGTVGAVTAPAAGAAAGCRVDYTVSNQWPGGFGANVNITNLGDPINGWRLTWSFPAGQTITQLWSGSHTQSGSQVTVTNVDYNAGLPTGGSANFGFNGSFNGSNPAPTSFALNGVTCTGGVTASPSPSTSPSTGPSPSSTPTSPGTCALPSTYRWTSTGPLANPKSGWVSLKDFTNVVHNGKHLVYATTHDTGTSWGSMNFSPFTNWSDMASAGQNKMNFSTVAPTLFYFAPKNIWVLAYQWGGTAFSYRTSSDPTNANGWSAQQTLFTGSISGSGTGPIDQTLIGDGTNMYLFFAGDNGKIYRASMPIGNFPGSFGSNYTTIMSDTTNNLFEGVEVYKLQGQNKYLMLVEAIGSQGRYFRSFTATSLDGTWTPQAATEGNPFAGKANSGATWTNDISHGDLVRSNPDQTKTVDPCNLQLLYQGRSPNSGGDYGLLPYRPGVLTLQR

SEQ ID NO: 60 - protein, 436 aa, Streptosporangium sp-60756
AGAAAGCRVDYTVSNQWPGGFGANVNITNLGDPINGWRLTWSFPAGQTITQLWSGSHTQSGSQVTVTNVDYNAGLPTGGSANFGFNGSFNGSNPAPTSFALNGVTCTGGVTASPSPSTSPSTGPSPSSTPTSPGTCALPSTYRWTSTGPLANPKSGWVSLKDFTNVVHNGKHLVYATTHDTGTSWGSMNFSPFTNWSDMASAGQNKMNFSTVAPTLFYFAPKNIWVLAYQWGGTAFSYRTSSDPTNANGWSAQQTLFTGSISGSGTGPIDQTLIGDGTNMYLFFAGDNGKIYRASMPIGNFPGSFGSNYTTIMSDTTNNLFEGVEVYKLQGQNKYLMLVEAIGSQGRYFRSFTATSLDGTWTPQAATEGNPFAGKANSGATWTNDISHGDLVRSNPDQTKTVDPCNLQLLYQGRSPNSGGDYGLLPYRPGVLTLQR

SEQ ID NO: 61 - DNA, 1416 bp, Artificial Sequence
  Expression construct
  CDS (1)..(1413)
  sig_peptide (1)..(81)
  mat_peptide (82)..(1413)
atgaagaaaccgttggggaaaattgtcgcaagcaccgcactactcatttctgttgcttttagttcatcgatagcatcagcacatcatcatcaccatcatcctagggccggcgccgccgccggatgccgcgtggactacacggtgagcaaccagtggccgggcggcttcggcgcgaacgtgaacatcaccaacctcggcgaccccatcaacggctggcgcctgacctggtcgttccccgcggggcagaccatcacccagctgtggagcggctcccacacccagtccggctcccaggtcaccgtgaccaacgtggactacaacgccggcctccccaccgggggcagcgcgaacttcgggttcaacggctccttcaacggcagcaacccggcaccgacgagcttcgccctcaacggtgtgacctgcaccggcggcgtgaccgcttcgcccagcccgtccaccagcccctcgaccggcccgtcgccgtcgtccacgccgacgtcgcccggcacctgcgctcttccgtcgacgtaccgctggacgtcgacgggcccgctggcgaacccgaagtcggggtgggtctcgctcaaggacttcaccaacgtcgtccacaacggcaagcacctcgtctacgccacgacgcacgacacggggacgagctggggctcgatgaacttcagccccttcacgaactggtccgacatggcctcggccggccagaacaagatgaacttctccaccgtcgcgcccacgctcttctacttcgccccgaagaacatctgggtgctggcctaccagtggggcgggaccgccttctcctaccggacctccagtgaccccaccaacgccaacggctggtcggcgcagcagaccctcttcaccggaagcatctccggctccggaaccgggcccatcgaccagacgctcatcggcgacggcaccaacatgtacctgttcttcgccggggacaacggcaagatctaccgggccagcatgccgatcgggaacttcccgggcagcttcggctcgaactacacgacgatcatgagcgacacgacgaacaacctgttcgaaggggtcgaggtctacaagctccaggggcagaacaagtacctcatgctcgtcgaggcgatcggctcgcagggtcgctacttccgctcgttcacggccaccagcctggacggcacatggacaccccaggccgcgaccgagggcaaccccttcgccggcaaggccaacagcggcgccacctggaccaacgacatcagccacggcgatctggtccgcagcaaccccgaccagaccaagaccgtcgacccctgcaacctgcaactgctctaccagggccgcagccccaactccggtggcgactacggcctgctgccctaccggccgggggtgctgacactgcagcgctga

SEQ ID NO: 62 - protein, 471 aa, Artificial Sequence
  Synthetic Construct
MKKPLGKIVASTALLISVAFSSSIASAHHHHHHPRAGAAAGCRVDYTVSNQWPGGFGANVNITNLGDPINGWRLTWSFPAGQTITQLWSGSHTQSGSQVTVTNVDYNAGLPTGGSANFGFNGSFNGSNPAPTSFALNGVTCTGGVTASPSPSTSPSTGPSPSSTPTSPGTCALPSTYRWTSTGPLANPKSGWVSLKDFTNVVHNGKHLVYATTHDTGTSWGSMNFSPFTNWSDMASAGQNKMNFSTVAPTLFYFAPKNIWVLAYQWGGTAFSYRTSSDPTNANGWSAQQTLFTGSISGSGTGPIDQTLIGDGTNMYLFFAGDNGKIYRASMPIGNFPGSFGSNYTTIMSDTTNNLFEGVEVYKLQGQNKYLMLVEAIGSQGRYFRSFTATSLDGTWTPQAATEGNPFAGKANSGATWTNDISHGDLVRSNPDQTKTVDPCNLQLLYQGRSPNSGGDYGLLPYRPGVLTLQR

SEQ ID NO: 63 - protein, 444 aa, Artificial Sequence
  Mature sequence with His-tag
HHHHHHPRAGAAAGCRVDYTVSNQWPGGFGANVNITNLGDPINGWRLTWSFPAGQTITQLWSGSHTQSGSQVTVTNVDYNAGLPTGGSANFGFNGSFNGSNPAPTSFALNGVTCTGGVTASPSPSTSPSTGPSPSSTPTSPGTCALPSTYRWTSTGPLANPKSGWVSLKDFTNVVHNGKHLVYATTHDTGTSWGSMNFSPFTNWSDMASAGQNKMNFSTVAPTLFYFAPKNIWVLAYQWGGTAFSYRTSSDPTNANGWSAQQTLFTGSISGSGTGPIDQTLIGDGTNMYLFFAGDNGKIYRASMPIGNFPGSFGSNYTTIMSDTTNNLFEGVEVYKLQGQNKYLMLVEAIGSQGRYFRSFTATSLDGTWTPQAATEGNPFAGKANSGATWTNDISHGDLVRSNPDQTKTVDPCNLQLLYQGRSPNSGGDYGLLPYRPGVLTLQR

SEQ ID NO: 64 - DNA, 1328 bp, Acrophialophora fusispora
  CDS (1)..(330)
  sig_peptide (1)..(57)
  mat_peptide (58)..(1325)
  CDS (403)..(655)
  CDS (795)..(948)
  CDS (1100)..(1325)
atgaagcttctcaactcgggtatcagcctgctggcattggcagtgggcgtcacggcgcagtgccccttgccctccacctaccgctggaaatcgacaggggtgcttgccaacccaaagtccggatgggtgtccctcaaagactttaccgtcgcgccgtacaacggcaagcatctcgtctacgctacgacccacgacacgggatcgagctggggctccatgaacttcggcctgttcagcagctggtccgacatggccacggccccccagaatgggatgaaccagggcactgttgcgcccaccctgttctacttcaagccgaaggatatctgggtacgtaattgcatcccagacttctttcgtttcccttcacgatgccatactcacgagattccccgtctcaaggtgctcgcgtatcaatggggcccgacgaccttctcctacaagacatcaaaggaccccaccaatgcgaacggctgggggtcggcgcagaccctcttctcggggaaaatctcgggctcttccaccggcgccattgaccagaccgtcattggcgatgacaccaacatgtacctcttcttcgccggcgacaacggcaagatctaccgcgccagcatgcccatcgacaggttccccggcagcttcggcgaccagtaccgtacgtccaatccgagttgttcattcccctttctaactgtctcgtgtgccctgggagtcgtgtggcctcttgagaggcttgtttgccactctcgagacacccacaaaataggcatccaatgactgacatagctgggcagagaccatcctgagcgatagcaccaacaacttgttcgaggccgtccaggtctacaagctccagggcttgaacaagtatctgatgattgtcgaggccattggcagcaacgggcgctacttccgctctttcacggctgacaggttggacgggcagtggtacgtctatccgctctcctttcccccccttttaagcgactctcatagtctcggcgtcaccttccccgcaaggcgactccgctcctcccaaaccgcccctcctcagcaacccaagtaccgtaagggttttctgactttaattcttgcacaggaccccccaggcagccaccgagagcaatcctttcgcgggcaaggcaaacagcggagcgacctggaccaacgatatcagccacggcgagctgatccgcgtgagcgccgaccagacctttacagtcgacccgtgcaacctgcagctgctctaccagggccgctcccccagctcgggcggcgactacgggaagctgccgtaccggccggggctgttgacgctgcagcgttaa

SEQ ID NO: 65 - protein, 321 aa, Acrophialophora fusispora
MKLLNSGISLLALAVGVTAQCPLPSTYRWKSTGVLANPKSGWVSLKDFTVAPYNGKHLVYATTHDTGSSWGSMNFGLFSSWSDMATAPQNGMNQGTVAPTLFYFKPKDIWVLAYQWGPTTFSYKTSKDPTNANGWGSAQTLFSGKISGSSTGAIDQTVIGDDTNMYLFFAGDNGKIYRASMPIDRFPGSFGDQYQTILSDSTNNLFEAVQVYKLQGLNKYLMIVEAIGSNGRYFRSFTADRLDGQWTPQAATESNPFAGKANSGATWTNDISHGELIRVSADQTFTVDPCNLQLLYQGRSPSSGGDYGKLPYRPGLLTLQR

SEQ ID NO: 66 - protein, 302 aa, Acrophialophora fusispora
QCPLPSTYRWKSTGVLANPKSGWVSLKDFTVAPYNGKHLVYATTHDTGSSWGSMNFGLFSSWSDMATAPQNGMNQGTVAPTLFYFKPKDIWVLAYQWGPTTFSYKTSKDPTNANGWGSAQTLFSGKISGSSTGAIDQTVIGDDTNMYLFFAGDNGKIYRASMPIDRFPGSFGDQYQTILSDSTNNLFEAVQVYKLQGLNKYLMIVEAIGSNGRYFRSFTADRLDGQWTPQAATESNPFAGKANSGATWTNDISHGELIRVSADQTFTVDPCNLQLLYQGRSPSSGGDYGKLPYRPGLLTLQR

SEQ ID NO: 67 - DNA, 1355 bp, Artificial Sequence
  Expression construct
  CDS (1)..(330)
  sig_peptide (1)..(57)
  mat_peptide (58)..(1352)
  CDS (403)..(655)
  CDS (795)..(948)
  CDS (1100)..(1352)
atgaagcttctcaactcgggtatcagcctgctggcattggcagtgggcgtcacggcgcagtgccccttgccctccacctaccgctggaaatcgacaggggtgcttgccaacccaaagtccggatgggtgtccctcaaagactttaccgtcgcgccgtacaacggcaagcatctcgtctacgctacgacccacgacacgggatcgagctggggctccatgaacttcggcctgttcagcagctggtccgacatggccacggccccccagaatgggatgaaccagggcactgttgcgcccaccctgttctacttcaagccgaaggatatctgggtacgtaattgcatcccagacttctttcgtttcccttcacgatgccatactcacgagattccccgtctcaaggtgctcgcgtatcaatggggcccgacgaccttctcctacaagacatcaaaggaccccaccaatgcgaacggctgggggtcggcgcagaccctcttctcggggaaaatctcgggctcttccaccggcgccattgaccagaccgtcattggcgatgacaccaacatgtacctcttcttcgccggcgacaacggcaagatctaccgcgccagcatgcccatcgacaggttccccggcagcttcggcgaccagtaccgtacgtccaatccgagttgttcattcccctttctaactgtctcgtgtgccctgggagtcgtgtggcctcttgagaggcttgtttgccactctcgagacacccacaaaataggcatccaatgactgacatagctgggcagagaccatcctgagcgatagcaccaacaacttgttcgaggccgtccaggtctacaagctccagggcttgaacaagtatctgatgattgtcgaggccattggcagcaacgggcgctacttccgctctttcacggctgacaggttggacgggcagtggtacgtctatccgctctcctttcccccccttttaagcgactctcatagtctcggcgtcaccttccccgcaaggcgactccgctcctcccaaaccgcccctcctcagcaacccaagtaccgtaagggttttctgactttaattcttgcacaggaccccccaggcagccaccgagagcaatcctttcgcgggcaaggcaaacagcggagcgacctggaccaacgatatcagccacggcgagctgatccgcgtgagcgccgaccagacctttacagtcgacccgtgcaacctgcagctgctctaccagggccgctcccccagctcgggcggcgactacgggaagctgccgtaccggccggggctgttgacgctgcagcgtacgcgtgcgcatcaccatcaccatcactaa

SEQ ID NO: 68 - protein, 330 aa, Artificial Sequence
  Synthetic Construct
MKLLNSGISLLALAVGVTAQCPLPSTYRWKSTGVLANPKSGWVSLKDFTVAPYNGKHLVYATTHDTGSSWGSMNFGLFSSWSDMATAPQNGMNQGTVAPTLFYFKPKDIWVLAYQWGPTTFSYKTSKDPTNANGWGSAQTLFSGKISGSSTGAIDQTVIGDDTNMYLFFAGDNGKIYRASMPIDRFPGSFGDQYQTILSDSTNNLFEAVQVYKLQGLNKYLMIVEAIGSNGRYFRSFTADRLDGQWTPQAATESNPFAGKANSGATWTNDISHGELIRVSADQTFTVDPCNLQLLYQGRSPSSGGDYGKLPYRPGLLTLQRTRAHHHHHH

SEQ ID NO: 69 - protein, 311 aa, Artificial Sequence
  Mature sequence with His tag
QCPLPSTYRWKSTGVLANPKSGWVSLKDFTVAPYNGKHLVYATTHDTGSSWGSMNFGLFSSWSDMATAPQNGMNQGTVAPTLFYFKPKDIWVLAYQWGPTTFSYKTSKDPTNANGWGSAQTLFSGKISGSSTGAIDQTVIGDDTNMYLFFAGDNGKIYRASMPIDRFPGSFGDQYQTILSDSTNNLFEAVQVYKLQGLNKYLMIVEAIGSNGRYFRSFTADRLDGQWTPQAATESNPFAGKANSGATWTNDISHGELIRVSADQTFTVDPCNLQLLYQGRSPSSGGDYGKLPYRPGLLTLQRTRAHHHHHH

SEQ ID NO: 70 - protein, 384 aa, Aspergillus aculeatus
VGLDQAAVAKGLQYFGTATDNPELTDIPYVTQLNNTADFGQITPGNSMKWDATEPSQGTFTFTKGDVIADLAEGNGQYLRCHTLVWYNQLPSWVTSGTWTNATLTAALKNHITNVVSHYKGKCLHWDVVNEALNDDGTYRTNIFYTTIGEAYIPIAFAAAAAADPDAKLFYNDYNLEYGGAKAASARAIVQLVKNAGAKIDGVGLQAHFSVGTVPSTSSLVSVLQSFTALGVEVAYTEADVRILLPTTATTLAQQSSDFQALVQSCVQTTGCVGFTIWDWTDKYSWVPSTFSGYGAALPWDENLVKKPAYNGLLAGMGVTVTTTTTTTTATATGKTTTTTTGATSTGTTAAHWGQCGGLNWSGPTACATGYTCTYVNDYYSQCL

SEQ ID NO: 71 - protein, 288 aa, Clostridium acetobutylicum
AMSHSKFVGNIIAGSIPSNFDTYWNQVTPENATKWGAIEYGRGNYNWGSADLIYNYARSKNMPFKFHNLVWGSQQLTWLSNLSPQDQKSEVSKWIAAAGQRYSGSAFVDVVNEPLHTQPSYKNALGGDGSTGYDWIVWSYQQARKAFPNSKLLINEYGIIGDPNAAANYVKIINVLKSKGLIDGIGIQCHYFNMDNVSVGTMNYVLNMLSNTGLPIYVSELDMTGDDSTQLARYQQKFPVLYQNPNVKGITLWGYMQGQTWNSGTYLVNSNGTERPALKWLRSYLASH

SEQ ID NO: 72 - protein, 308 aa, Aspergillus aculeatus
NPIEPRQASVSIDAKFKAHGKKYLGTIGDQYTLNKNAKTPAIIKADFGQLTPENSMKWDATEPNRGQFSFSGSDYLVNFAQSNGKLIRGHTLVWHSQLPSWVQSISDKNTLIQVMQNHITTVMQRYKGKVYAWDVVNEIFNEDGSLCQSHFYNVIGEDYVRIAFETARAVDPNAKLYINDYNLDSASYPKLTGLVNHVKKWVAAGVPIDGIGSQTHLSAGAGAAVSGALNALAGAGTKEVAITELDIAGASSTDYVNVVKACLNQPKCVGITVWGSSDPDSWRSSSSPLLFDSNYNPKAAYTAIANAL

SEQ ID NO: 73 - protein, 195 aa, Thermomyces lanuginosus
RQTTPNSEGWHDGYYYSWWSDGGAQATYTNLEGGTYEISWGDGGNLVGGKGWNPGLNARAIHFEGVYQPNGNSYLAVYGWTRNPLVEYYIVENFGTYDPSSGATDLGTVECDGSIYRLGKTTRVNAPSIDGTQTFDQYWSVRQDKRTSGTVQTGCHFDAWARAGLNVNGDHYYQIVATEGYFSSGYARITVADVG

SEQ ID NO: 74 - protein, 203 aa, Dictyoglomus thermophilum
QTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGATSLGQVTIDGGTYDIYRTTRVNQPSIVGTATFDQYWSVRTSKRTSGTVTVTDHFRAWANRGLNLGTIDQITLCVEGYQSSGSANITQNTFSQGS

SEQ ID NO: 75 - protein, 182 aa, Paenibacillus Pabuli
TDYWQNWTDGGGTVNAVNGSGGNYSVNWQNTGNFVVGKGWTYGTPNRVVNYNAGVFSPSGNGYLTFYGWTRNALIEYYVVDNWGTYRPTGTYKGTVTSDGGTYDIYTTMRYNQPSIDGYSTFPQYWSVRQSKRPIGVNSQITFQNHVNAWASKGMYLGNSWSYQVMATEGYQSSGSSNVTVW

SEQ ID NO: 76 - DNA, 633 bp, Geobacillus stearothermophilus
  CDS (1)..(630)
  sig_peptide (1)..(81)
  mat_peptide (82)..(633)
atgaagttaaagaagaagatgcttactctactcctgacggcttcgatgagtttcggtttatttggggcaacctcaagtgcagcaacggattattggcaatattggacggatggcggcgggatggtgaatgcggttaatgggcccggaggcaattacagtgttacctggcaaaataccgggaacttcgtggtcggcaaaggctggacggttggatcgccgaatcgggtgatcaactacaatgcgggcatctgggaaccttcggggaacgggtacttaaccctttacggatggacgaggaacgcgctgatcgagtattacgttgtggacagctgggggacgtaccggcctaccggcaattacaagggaacggtgaacagcgacggaggaacttacgatatttatacgaccatgcgttataatgcaccttccattgatggcacgcagacgttccaacagttctggagtgtgcggcaatcgaaacgacctaccggcagcaacgtatccatcaccttcagcaatcacgtgaatgcctggagaagcaagggcatgaacctgggcagcagctgggcttatcaggttctggcgacggaaggctatcagagcagcggaagatccaacgttacggtttggtaa

SEQ ID NO: 77 - protein, 210 aa, Geobacillus stearothermophilus
MKLKKKMLTLLLTASMSFGLFGATSSAATDYWQYWTDGGGMVNAVNGPGGNYSVTWQNTGNFVVGKGWTVGSPNRVINYNAGIWEPSGNGYLTLYGWTRNALIEYYVVDSWGTYRPTGNYKGTVNSDGGTYDIYTTMRYNAPSIDGTQTFQQFWSVRQSKRPTGSNVSITFSNHVNAWRSKGMNLGSSWAYQVLATEGYQSSGRSNVTVW

SEQ ID NO: 78 - protein, 183 aa, Geobacillus stearothermophilus
ATDYWQYWTDGGGMVNAVNGPGGNYSVTWQNTGNFVVGKGWTVGSPNRVINYNAGIWEPSGNGYLTLYGWTRNALIEYYVVDSWGTYRPTGNYKGTVNSDGGTYDIYTTMRYNAPSIDGTQTFQQFWSVRQSKRPTGSNVSITFSNHVNAWRSKGMNLGSSWAYQVLATEGYQSSGRSNVTVW

SEQ ID NO: 79 - DNA, 627 bp, Artificial Sequence
  Synthetic construct
  CDS (1)..(624)
  sig_peptide (1)..(81)
  mat_peptide (82)..(624)
atgaagaaaccgttggggaaaattgtcgcaagcaccgcactactcatttctgttgcttttagttcatcgatcgcatcggctgactattggcaatactggacagatggtggcggtatggttaacgctgttaacggtcctggaggcaactattctgttacttggcagaacacaggcaacttcgttgttggcaaaggatggacggttggttctcctaaccgcgttatcaactacaacgctggcatctgggagccttctggcaacggttaccttacgctttacggctggacacgcaacgctcttatcgagtactatgttgttgactcttggggcacttatcgccctacgggcaactacaaaggcacggtaaactctgatggtggcacgtacgacatctatacaacaatgcgctacaacgctccttctatcgacggcactcagacttttcaacagttttggtcagttcgccaatctaaacgccctacaggctctaacgtttctatcacattctctaaccatgttaacgcttggcgctctaaaggcatgaaccttggcagctcatgggcttatcaagtacttgcaactgagggctaccaatcttctggacgctctaacgttacagtatggtaa

SEQ ID NO: 80 - protein, 208 aa, Artificial Sequence
  Synthetic Construct
MKKPLGKIVASTALLISVAFSSSIASADYWQYWTDGGGMVNAVNGPGGNYSVTWQNTGNFVVGKGWTVGSPNRVINYNAGIWEPSGNGYLTLYGWTRNALIEYYVVDSWGTYRPTGNYKGTVNSDGGTYDIYTTMRYNAPSIDGTQTFQQFWSVRQSKRPTGSNVSITFSNHVNAWRSKGMNLGSSWAYQVLATEGYQSSGRSNVTVW

SEQ ID NO: 81 - protein, 181 aa, Artificial Sequence
  Mature sequence
DYWQYWTDGGGMVNAVNGPGGNYSVTWQNTGNFVVGKGWTVGSPNRVINYNAGIWEPSGNGYLTLYGWTRNALIEYYVVDSWGTYRPTGNYKGTVNSDGGTYDIYTTMRYNAPSIDGTQTFQQFWSVRQSKRPTGSNVSITFSNHVNAWRSKGMNLGSSWAYQVLATEGYQSSGRSNVTVW

SEQ ID NO: 82 - DNA, 1026 bp, Streptomyces beijiangensis
  CDS (1)..(1023)
  sig_peptide (1)..(126)
  mat_peptide (127)..(1023)
atgagcgcacccgtgccactgccccgcagacgcagacccggccgcttcatgaccctgctgagaagctcctgggcgatcgccctggccgcggtcgccgtgctgctgctgcccaacgccgccagcgccgacaccgtcgtcaactcgaaccagaccggcaccaacaacggttactactactcgcactggagcgatggcggcggctcggtgtcgatgacgctgggctcgggcggcaactacggctaccagtggagcaacgtcggaaacttcgtcggcggcaaggggtggagcaccggcggacgcaagtccgtgaactactccggcagtttcaacccgtcgggcaacgcctacctcgcgctctacggctggaccaccaacccgctggtcgagtactacgtcgtcgagaacttcggcacgtaccgccccaccggcaccttcaagggcacggtcaccagcgacggaggcacctacgacatctatgagacgacccgggtgaaccagccctcgatcgagggcaccaagaccttcaagcagtactggagcgtccgccagtcgaagcggacggggggcaccatcaccacgggcaaccacttcgacgcctggtcgagccacggcatgagcatgggttccttcaactacatgatcatggcgaccgagggctaccagagcagcggcagctccaacatcaccgtcagcgagggcagttccggtggcgggacgggcggtggcggcacgggcggcggtacgggcggcggcggctccggcggctgcaccgcgacgctttccgcgggagacaagtggagcgaccgctacaacctgaacgtctccgtctccggcgccggcaactggaccgtcacgatgaaggtcccctcgcccgagaaggtgctgtccacctggaacgtgagcgccgcctacccggacagccagaccctcgtggccaagtccaacggcagcggcagcaactggggggcgaccatccagaccaacggctcctggacgtggcccacggtcacctgcagcgccggctga

SEQ ID NO: 83 - protein, 341 aa, Streptomyces beijiangensis
MSAPVPLPRRRRPGRFMTLLRSSWAIALAAVAVLLLPNAASADTVVNSNQTGTNNGYYYSHWSDGGGSVSMTLGSGGNYGYQWSNVGNFVGGKGWSTGGRKSVNYSGSFNPSGNAYLALYGWTTNPLVEYYVVENFGTYRPTGTFKGTVTSDGGTYDIYETTRVNQPSIEGTKTFKQYWSVRQSKRTGGTITTGNHFDAWSSHGMSMGSFNYMIMATEGYQSSGSSNITVSEGSSGGGTGGGGTGGGTGGGGSGGCTATLSAGDKWSDRYNLNVSVSGAGNWTVTMKVPSPEKVLSTWNVSAAYPDSQTLVAKSNGSGSNWGATIQTNGSWTWPTVTCSAG

SEQ ID NO: 84 - protein, 299 aa, Streptomyces beijiangensis
DTVVNSNQTGTNNGYYYSHWSDGGGSVSMTLGSGGNYGYQWSNVGNFVGGKGWSTGGRKSVNYSGSFNPSGNAYLALYGWTTNPLVEYYVVENFGTYRPTGTFKGTVTSDGGTYDIYETTRVNQPSIEGTKTFKQYWSVRQSKRTGGTITTGNHFDAWSSHGMSMGSFNYMIMATEGYQSSGSSNITVSEGSSGGGTGGGGTGGGTGGGGSGGCTATLSAGDKWSDRYNLNVSVSGAGNWTVTMKVPSPEKVLSTWNVSAAYPDSQTLVAKSNGSGSNWGATIQTNGSWTWPTVTCSAG

SEQ ID NO: 85 - DNA, 1005 bp, Artificial Sequence
  Expression construct
  CDS (1)..(1002)
  sig_peptide (1)..(81)
  mat_peptide (82)..(1002)
atgaagaaaccgttggggaaaattgtcgcaagcaccgcactactcatttctgttgcttttagttcatcgatagcatcagcacatcatcatcaccatcatcctagggacaccgtcgtcaactcgaaccagaccggcaccaacaacggttactactactcgcactggagcgatggcggcggctcggtgtcgatgacgctgggctcgggcggcaactacggctaccagtggagcaacgtcggaaacttcgtcggcggcaaggggtggagcaccggcggacgcaagtccgtgaactactccggcagtttcaacccgtcgggcaacgcctacctcgcgctctacggctggaccaccaacccgctggtcgagtactacgtcgtcgagaacttcggcacgtaccgccccaccggcaccttcaagggcacggtcaccagcgacggaggcacctacgacatctatgagacgacccgggtgaaccagccctcgatcgagggcaccaagaccttcaagcagtactggagcgtccgccagtcgaagcggacggggggcaccatcaccacgggcaaccacttcgacgcctggtcgagccacggcatgagcatgggttccttcaactacatgatcatggcgaccgagggctaccagagcagcggcagctccaacatcaccgtcagcgagggcagttccggtggcgggacgggcggtggcggcacgggcggcggtacgggcggcggcggctccggcggctgcaccgcgacgctttccgcgggagacaagtggagcgaccgctacaacctgaacgtctccgtctccggcgccggcaactggaccgtcacgatgaaggtcccctcgcccgagaaggtgctgtccacctggaacgtgagcgccgcctacccggacagccagaccctcgtggccaagtccaacggcagcggcagcaactggggggcgaccatccagaccaacggctcctggacgtggcccacggtcacctgcagcgccggctga

SEQ ID NO: 86 - protein, 334 aa, Artificial Sequence
  Synthetic Construct
MKKPLGKIVASTALLISVAFSSSIASAHHHHHHPRDTVVNSNQTGTNNGYYYSHWSDGGGSVSMTLGSGGNYGYQWSNVGNFVGGKGWSTGGRKSVNYSGSFNPSGNAYLALYGWTTNPLVEYYVVENFGTYRPTGTFKGTVTSDGGTYDIYETTRVNQPSIEGTKTFKQYWSVRQSKRTGGTITTGNHFDAWSSHGMSMGSFNYMIMATEGYQSSGSSNITVSEGSSGGGTGGGGTGGGTGGGGSGGCTATLSAGDKWSDRYNLNVSVSGAGNWTVTMKVPSPEKVLSTWNVSAAYPDSQTLVAKSNGSGSNWGATIQTNGSWTWPTVTCSAG

SEQ ID NO: 87 - protein, 307 aa, Artificial Sequence
  Mature sequence with His-tag
HHHHHHPRDTVVNSNQTGTNNGYYYSHWSDGGGSVSMTLGSGGNYGYQWSNVGNFVGGKGWSTGGRKSVNYSGSFNPSGNAYLALYGWTTNPLVEYYVVENFGTYRPTGTFKGTVTSDGGTYDIYETTRVNQPSIEGTKTFKQYWSVRQSKRTGGTITTGNHFDAWSSHGMSMGSFNYMIMATEGYQSSGSSNITVSEGSSGGGTGGGGTGGGTGGGGSGGCTATLSAGDKWSDRYNLNVSVSGAGNWTVTMKVPSPEKVLSTWNVSAAYPDSQTLVAKSNGSGSNWGATIQTNGSWTWPTVTCSAG

SEQ ID NO: 88 - protein, 188 aa, Fusarium oxysporum
TQPTTGTSGGYYFSFWTDTPNSVTYTNGNGGQFSMQWSGNGNHVGGKGWMPGTSRTIKYSGSYNPNGNSYLAVYGWTRNPLIEYYIVENFGTYNPSSGGQKKGEVNVDGSVYDIYVSTRVNAPSIDGNKTFQQYWSVRRNKRSSGSVNTGAHFQAWKNVGLNLGTHDYQILAVEGYYSSGSASMTVSQ

SEQ ID NO: 89 - protein, 189 aa, Aspergillus clavatus
AGTPSSTGWNNGYYYSFWTDNGGTVNYQNGNGGSYSVQWKDTGNFVGGKGWNPGSARTINYSGSFNPSGNAYLTVYGWTTNPLVEYYIVENYGTYNPGNGGTYRGSVYSDGANYNIYTATRYNAPSIEGDKTFTQYWSVRQSKRTGGTVTTANHFNAWAQLGMSLGTHNYQIVATEGYQSSGSSSITVY

SEQ ID NO: 90 - protein, 27 aa, Artificial Sequence
  Bacillus lentus secretion signal
MKKPLGKIVASTALLISVAFSSSIASA

SEQ ID NO: 91 - protein, 8 aa, Artificial Sequence
  His-tag RHHHHHHP
RHHHHHHP

SEQ ID NO: 92 - protein, 8 aa, Artificial Sequence
  His-tag HHHHHHPR
HHHHHHPR

SEQ ID NO: 93 - protein, 558 aa, Humicola insolens
  signal (1)..(18)
  mat_peptide (19)..(558)
MLGLKVLCLSAVVGTAVSVPHAGNLPRQASTFTNPVLWEDHPDLEVFRVGSVFYYSSSTFAYSPGAPVLKSYDLVHWTPVTHSVPRLNFGSNYDLPSGTPGAYVKGIWASTLRYRRSNDRFYWYGCVEGRTYLWTSPGGNALANNGEVPPSAWNWQHTATIDNCYYDAGLLIDDDDTMYIAYGNPTINVAQLSPDGTRQVRVQQRVYAHPQGQTVEGARMYKIRGNYYILVTRPADAEYVLRSTTGSPFGPYEARTLVSRIQGPLANAGFAHQGGIVDAPDGTWHYVAFMDAYPGGRIPVVAPLRWTADGWPEVVTDSQGRWGTSYPIPVRGAKNATEGLASTDLDEFRGTRFSEHWEWNHNPDTSKFTLLGGNEGGLILRTATVTGDLFAARNTLTRRIAGPKASGIFRLDVRGMRDGDRAGAVLFRDRAAYIGVWKQGNEARIVMVDDLRLNEDGWRTASTGRVAANGPVIDTNAQQDIWLRIDADITPAFGTNTERTTTFYYSIDGGRTYTRLGPAFAMTNSWRYFTGYRFGVFNFSTKSLGGEVKVKGFKMNMI

SEQ ID NO: 94 - protein, 643 aa, Meripilus giganteus
  signal (1)..(16)
  mat_peptide (17)..(643)
MKLLFLLGAFVAQCLAVTVTVNKNPSHTVPSTLYGLMFEDINHSGDGGLYAELLQNRAFQQVTPNTAAALAAWHPISNAKLAVIQDPSPVSNALPNSLQFSVPSGSSGRVGFTNEGFWGIKVDSTWTYKASLFFRFPTSSSFSGALTVGLQTNAGRVLAQNSTQIRGTTTKWTQINLELHPTASAPDVSNSFFVTIDGAAGAGQTINFAMFSLFPPTFKNRPNGLRADIAETLAEMGPSFFRFPGGNNLEGQTTATRWQWNATVGSLLDRPGRVGDWGYVNTDGLGLLEYLQFFEDTGMEPIMAVWAGYSLGGTSLAENQLAPYIQQAIDQINFVIGDPAKSAPAALRASLGHPEPFTLRFVEVGNEDFFAAGSYPYRWHDFVTALQAQFPQIRFIATTNAWNPVLSPVPQSYDVHVYQTPTWFYQNAFYYDGFQRNGTTYFEGEYAAISTNANDLFGTVADGRLAFPTVQSATGEAAFMTGLERNSDIVFAASYAPLLQHVNSTQWTPDLVSYDAGSVIKSTSFFAQKLFALNKGDQYLPSTLPTNGGTLHWSITRASSSGKTFIKIANAGSSAQSLTFQLTQFNSVSSTGTLQVLTGPETASNTPEAPQAIVPKTSTIGTGKTFTYNAPAFSVSVITVTTN

SEQ ID NO: 95 - protein, 328 aa, Thermotoga maritima MSB8
  mat_peptide (1)..(328)
SQNVSLRELAEKLNIYIGFAAINNFWSLSDAEKYMEVARREFNILTPENQMKWDTIHPERDRYNFTPAEKHVEFAEENDMIVHGHTLVWHNQLPGWITGREWTKEELLNVLEDHIKTVVSHFKGRVKIWDVVNEAVSDSGTYRESVWYKTIGPEYIEKAFRWAKEADPDAILIYNDYSIEEINAKSNFVYNMIKELKEKGVPVDGIGFQMHIDYRGLNYDSFRRNLERFAKLGLQIYITEMDVRIPLSGSEEYYLKKQAEVCAKIFDICLDNPAVKAIQFWGFTDKYSWVPGFFKGYGKALLFDENYNPKPCYYAIKEVLEKKIEERK

SEQ ID NO: 96 - protein, 208 aa, Myceliophthora thermophila
  mat_peptide (1)..(208)
RPFDFDDGNSTEALAKRQVTPNAQGYHSGYFYSWWSDGGGQATFTLLEGSHYQVNWRNTGNFVGGKGWNPGTGRTINYGGSFNPSGNGYLAVYGWTHNPLIEYYVVESYGTYNPGSQAQYKGSFQSDGGTYNIYVSTRYNAPSIEGTRTFQQYWSIRTSKRVGGSVTMQNHFNAWAQHGMPLGSHDYQIVATEGYQSSGSSDIYVQTH

SEQ ID NO: 97 - DNA, 727 bp, Lasiodiplodia theobromae
  sig_peptide (1)..(57)
  CDS (1)..(269)
  mat_peptide (58)..(724)
  CDS (328)..(724)
atggtgtccttccgctctctcttccttggcctttccgccgtcgccggcgtcttctctgctcccgccgctgaggccggcgagttgattgccaggcagtctctcacttccagccaaaccggcaccaacaatggctactactactctttctggaccgatggtggcggtgccgtcacctacaccaacggcgctgctggcaagtacagcgtccagtggtccggcggcaatggaaactttgtcgccggcaagggttggagcactggcagtgccaggtaagttcgccattaccatccaattgatatacagcaagctgatttacccgctcctcaggaacatcaagttttcgggtagcttcaaccccaacggcaacggctacctctccgtctacggctggaccaccagccctctgattgagtactacatcgtcgagtcgtacggcgactacaacccgggctccgagggcaccaagaagggcacagtcacctcggacggcagcgtctacgacatctacacctcgacccgcaccaacgctccttcgatccagggcaccgccaccttcactcagtactggtccatccgccgcaaccaccgcagcagcggcaccgtcaccaccaagaaccactttgacgcctgggccaagctcggcctcaagctcggcacccacaactaccagattgtcgccaccgagggctaccacagctccggttcctccagcatcaccgtctcctaa

SEQ ID NO: 98 - protein, 222 aa, Lasiodiplodia theobromae
MVSFRSLFLGLSAVAGVFSAPAAEAGELIARQSLTSSQTGTNNGYYYSFWTDGGGAVTYTNGAAGKYSVQWSGGNGNFVAGKGWSTGSARNIKFSGSFNPNGNGYLSVYGWTTSPLIEYYIVESYGDYNPGSEGTKKGTVTSDGSVYDIYTSTRTNAPSIQGTATFTQYWSIRRNHRSSGTVTTKNHFDAWAKLGLKLGTHNYQIVATEGYHSSGSSSITVS

SEQ ID NO: 99 - protein, 203 aa, Lasiodiplodia theobromae
  mat_peptide (1)..(203)
APAAEAGELIARQSLTSSQTGTNNGYYYSFWTDGGGAVTYTNGAAGKYSVQWSGGNGNFVAGKGWSTGSARNIKFSGSFNPNGNGYLSVYGWTTSPLIEYYIVESYGDYNPGSEGTKKGTVTSDGSVYDIYTSTRTNAPSIQGTATFTQYWSIRRNHRSSGTVTTKNHFDAWAKLGLKLGTHNYQIVATEGYHSSGSSSITVS

SEQ ID NO: 100 - DNA, 1273 bp, Ascobolus stictoideus
  CDS (1)..(71)
  sig_peptide (1)..(54)
  mat_peptide (55)..(1270)
  CDS (121)..(524)
  CDS (594)..(1054)
  CDS (1142)..(1270)
atgcgtttctccatttctgctgccatcttgggcctcagcaccctcattgctgccaatacagtcccatctgcgtaagctatctttcccccctcatctcatcccattgctaattcacctcagactcgaaccccgtcaagcgcagaccatccaggcagccttactcgccaaaggcaagaagtattttggtacctctatcaccatccgcaatgacaacaccgagcaaaacctaatgcgcggtaacgaatttggatctctcacccccgagaactccatgaagtgggatgccatccaacccaaccgcaatcaattcaactggggaggtgccgatcaagttgccaactttgccactcaaaacggcaagcaattgagatgccatacccttgtctggcactcgcagctcccaggatgggtctctaacagtggattcaacaatgctacgttgatccaagtcatgaccactcacatccaaaccgtcatggcacggtacagagggaaatgtacccactgggacgttgtcaacgaaggtaaacccatccatcccgtgcccccagctcgccttcatcctcattaaactaacctctcctttcttgtagctctcgaagaaaacggttcctggaggaacagcgtcttctaccgcgtcatcggccccgccttcatcccaatcgccttccgcatcgccgcccaagccgaccccagcgccatcctctactacaacgactacaacctcgaataccgtggccccaagcaccgagccgctctcgaaatcgtcaagctcgttaaatcctacggtgttcgcatcgatggtgtcggtctccaaggtcatctcgtcgtagaaagaaccccaactcaagaaacacccactccatctcttgatgtactccaaggtgtacttgaggattatgctgctcttggtgtcgatactgcttatacggaaattgatatccgtatgaactcaccatttactcagcagaaattgaatactcaggcggaacattatgctagagttgctcagagttgtatgaatgttcctcgttgtgttggattgactgtttgggtaagttgatcattaattccccattctaataattggaagatatcgtttttggtgatcttttgggctaacgcattggtgctataatagggtgtgtctgatagatactcgtgggttccaggaactttccctggtgagggtgctgcccttctctggaatgataactatcagaagaagccagcatacgatgctgtattacgggctattaataacagcagttaa

SEQ ID NO: 101 - protein, 355 aa, Ascobolus stictoideus
MRFSISAAILGLSTLIAANTVPSALEPRQAQTIQAALLAKGKKYFGTSITIRNDNTEQNLMRGNEFGSLTPENSMKWDAIQPNRNQFNWGGADQVANFATQNGKQLRCHTLVWHSQLPGWVSNSGFNNATLIQVMTTHIQTVMARYRGKCTHWDVVNEALEENGSWRNSVFYRVIGPAFIPIAFRIAAQADPSAILYYNDYNLEYRGPKHRAALEIVKLVKSYGVRIDGVGLQGHLVVERTPTQETPTPSLDVLQGVLEDYAALGVDTAYTEIDIRMNSPFTQQKLNTQAEHYARVAQSCMNVPRCVGLTVWGVSDRYSWVPGTFPGEGAALLWNDNYQKKPAYDAVLRAINNSS

SEQ ID NO: 102 - protein, 337 aa, Ascobolus stictoideus
  mat_peptide (1)..(337)
NTVPSALEPRQAQTIQAALLAKGKKYFGTSITIRNDNTEQNLMRGNEFGSLTPENSMKWDAIQPNRNQFNWGGADQVANFATQNGKQLRCHTLVWHSQLPGWVSNSGFNNATLIQVMTTHIQTVMARYRGKCTHWDVVNEALEENGSWRNSVFYRVIGPAFIPIAFRIAAQADPSAILYYNDYNLEYRGPKHRAALEIVKLVKSYGVRIDGVGLQGHLVVERTPTQETPTPSLDVLQGVLEDYAALGVDTAYTEIDIRMNSPFTQQKLNTQAEHYARVAQSCMNVPRCVGLTVWGVSDRYSWVPGTFPGEGAALLWNDNYQKKPAYDAVLRAINNSS

SEQ ID NO: 103 - DNA, 981 bp, Drechslera sp.
  CDS (1)..(978)
  sig_peptide (1)..(72)
  mat_peptide (73)..(978)
atgcgtttcattcccaccgacattagcatctccgcggctgcgctcgcgctcctggcttcgactgcgtcggcccagaactgcaagcttcctacctcctacaagtggacggacagtggtgttcttgctcagcccaagtctggctgggcttcgctcaaggacttcaccatctctagcgtaaacggcaagcacattgtctacgctaccaaccacgacactggctccaagtatggatccatgaactttggtgccttcggcgacttcagccagatgaaatctgcctcgcagaacggcatgagcttcactgctgttgctcctaccctcttccacttcgctcccaagaacgtctgggttctcgcctaccagtggggacctaccaccttctcctacaggacctccagcgaccccaccaacgccaacagctggggtcccgctcagcctctcttcactggcaagatcagtggcagcggcactggtgctattgaccagactgtcattggtgacagcaagaacatgtacctcttcttcgctggtgacaacggcaagatctaccgctccagcatgcccaagtccaacttccctggcaacttcggcactgcctccaccgtcatcatgagcgactccgcccagaaccttttcgaggccgtccaggtctacaccgtcaagggtggcggttacctcatgatcgtcgaggcccagagtggaaacggacgttacttccgctctttcactgcctccagcctcgacggcaactggacccccaacgccgccactcagagcaaccccttcgccggcaaggctaacagcggtgccacctggaccaacgacatctcccacggtgaccttgtcaaggtcaccaacgacgagaccatgactgtcgacccttgcaacctgcagctgttgtaccagggccgcaaccccaacgctggtggcgactacgaccgtctcccctacaggcccggtctccttaccctcaggaagtaa

SEQ ID NO: 104 - protein, 326 aa, Drechslera sp.
MRFIPTDISISAAALALLASTASAQNCKLPTSYKWTDSGVLAQPKSGWASLKDFTISSVNGKHIVYATNHDTGSKYGSMNFGAFGDFSQMKSASQNGMSFTAVAPTLFHFAPKNVWVLAYQWGPTTFSYRTSSDPTNANSWGPAQPLFTGKISGSGTGAIDQTVIGDSKNMYLFFAGDNGKIYRSSMPKSNFPGNFGTASTVIMSDSAQNLFEAVQVYTVKGGGYLMIVEAQSGNGRYFRSFTASSLDGNWTPNAATQSNPFAGKANSGATWTNDISHGDLVKVTNDETMTVDPCNLQLLYQGRNPNAGGDYDRLPYRPGLLTLRK

SEQ ID NO: 105 - protein, 302 aa, Drechslera sp.
  mat_peptide (1)..(302)
QNCKLPTSYKWTDSGVLAQPKSGWASLKDFTISSVNGKHIVYATNHDTGSKYGSMNFGAFGDFSQMKSASQNGMSFTAVAPTLFHFAPKNVWVLAYQWGPTTFSYRTSSDPTNANSWGPAQPLFTGKISGSGTGAIDQTVIGDSKNMYLFFAGDNGKIYRSSMPKSNFPGNFGTASTVIMSDSAQNLFEAVQVYTVKGGGYLMIVEAQSGNGRYFRSFTASSLDGNWTPNAATQSNPFAGKANSGATWTNDISHGDLVKVTNDETMTVDPCNLQLLYQGRNPNAGGDYDRLPYRPGLLTLRK

SEQ ID NO: 106 - DNA, 1503 bp, Xylanibacterium sp-61981
  CDS (1)..(1500)
  sig_peptide (1)..(108)
  mat_peptide (109)..(1500)
atgaccagaagaaggtccatcgcaattcatgcactgggggccgccaccgccctggtgctggccttggtggcggcgacagcaccgatccaggctgcacccgccgccgctgcgagcggcaacctgctgacgaacggcgacatggagaacggcacgaccggctggtcggtcttcggcgccgggtcgctggcgtccgtcacgagcccggtccacggcgggtcccgcgcgctgtcgcggaccggtcgcacggcggcgtggaacggcccggcccagaccgtgacctccgtgctgacgaacaacaacagctacacggcgagcgtgtgggtgcggtcgcagagcgggaccccgaccggccgggtcacgttgcaggtgaccgccggcggcacgacgaactacgtcaacctggcgcaggggaccgtgaactcctccggctggacgcagctgaccggcaccaccaacgtgtcctggaccgggacgctgtcgtccgccacgttctacgtggagacatccgcggggaccgacagtctttacgtcgacgacgcctcgctcgtcaacaactcgacgccgccgtccgggacgtgcgacctgccgtcgacctaccgctggtcgtccaccggtgtcctcgcgaccccgaaggccggctgggtatcgctgaaggacttcaccacggcgccgtacaacggccagcacctcgtctacgcgacgaccaacaccggggcctcgacaggaaccacgtggggctcgatgaacttcagcctcttcagcaactggtccgacatggcctccgccacgcagaacacgatgtcgtccgcgaccgtggccccgtcactcttctacttcgccccgaagaacatctgggtgctcacctaccagtggggcccaggcgccgccttcttctaccggacgtcgaacgaccccacgaacgcgaacggctggtcgtccgccaacgtcctcttctccgggtccatctccggctccagcaccggtcccatcgaccagacgatcatcggtgacggcacgaacatgtacctgttcttcgccggggacaacgggttcatctaccgggccagcatgccgatcggcaacttcccgggcagcttcggcagctcgtcgaccgtcgtcatgagcgacaccacgaacaacgggtggaacctgttcgaggcgccccaggtctacaagctcaaggaccagaacaagtacctcatgatcgtcgaggccatcggcgccaacggccggtacttccgctcgttcaccgcgaccagcctctccggctcgtggacgccgcaggccgcgaccgagagcaacccgttcgcgggcaaggccaacagcggtgccacctggaccaacgacatcagccacggtgagctcatccgcaccagcgccgaccagaccatgacgatcgacccctgcaacctgcagctgctgtaccagggccgctcccccagctccggtggggactacggcacgtggccgtaccggccgggcctgctcacgctgcagcgatag

SEQ ID NO: 107 - protein, 500 aa, Xylanibacterium sp-61981
MTRRRSIAIHALGAATALVLALVAATAPIQAAPAAAASGNLLTNGDMENGTTGWSVFGAGSLASVTSPVHGGSRALSRTGRTAAWNGPAQTVTSVLTNNNSYTASVWVRSQSGTPTGRVTLQVTAGGTTNYVNLAQGTVNSSGWTQLTGTTNVSWTGTLSSATFYVETSAGTDSLYVDDASLVNNSTPPSGTCDLPSTYRWSSTGVLATPKAGWVSLKDFTTAPYNGQHLVYATTNTGASTGTTWGSMNFSLFSNWSDMASATQNTMSSATVAPSLFYFAPKNIWVLTYQWGPGAAFFYRTSNDPTNANGWSSANVLFSGSISGSSTGPIDQTIIGDGTNMYLFFAGDNGFIYRASMPIGNFPGSFGSSSTVVMSDTTNNGWNLFEAPQVYKLKDQNKYLMIVEAIGANGRYFRSFTATSLSGSWTPQAATESNPFAGKANSGATWTNDISHGELIRTSADQTMTIDPCNLQLLYQGRSPSSGGDYGTWPYRPGLLTLQR

SEQ ID NO: 108 - protein, 464 aa, Xylanibacterium sp-61981
  mat_peptide (1)..(464)
ASGNLLTNGDMENGTTGWSVFGAGSLASVTSPVHGGSRALSRTGRTAAWNGPAQTVTSVLTNNNSYTASVWVRSQSGTPTGRVTLQVTAGGTTNYVNLAQGTVNSSGWTQLTGTTNVSWTGTLSSATFYVETSAGTDSLYVDDASLVNNSTPPSGTCDLPSTYRWSSTGVLATPKAGWVSLKDFTTAPYNGQHLVYATTNTGASTGTTWGSMNFSLFSNWSDMASATQNTMSSATVAPSLFYFAPKNIWVLTYQWGPGAAFFYRTSNDPTNANGWSSANVLFSGSISGSSTGPIDQTIIGDGTNMYLFFAGDNGFIYRASMPIGNFPGSFGSSSTVVMSDTTNNGWNLFEAPQVYKLKDQNKYLMIVEAIGANGRYFRSFTATSLSGSWTPQAATESNPFAGKANSGATWTNDISHGELIRTSADQTMTIDPCNLQLLYQGRSPSSGGDYGTWPYRPGLLTLQR

SEQ ID NO: 109 - DNA, 1500 bp, Artificial Sequence
  Expression construct
  CDS (1)..(1497)
  sig_peptide (1)..(81)
  mat_peptide (82)..(1497)
atgaagaaaccgttggggaaaattgtcgcaagcaccgcactactcatttctgttgcttttagttcatcgatagcatcagcacatcatcatcaccatcatcctagggcgagcggcaacctgctgacgaacggcgacatggagaacggcacgaccggctggtcggtcttcggcgccgggtcgctggcgtccgtcacgagcccggtccacggcgggtcccgcgcgctgtcgcggaccggtcgcacggcggcgtggaacggcccggcccagaccgtgacctccgtgctgacgaacaacaacagctacacggcgagcgtgtgggtgcggtcgcagagcgggaccccgaccggccgggtcacgttgcaggtgaccgccggcggcacgacgaactacgtcaacctggcgcaggggaccgtgaactcctccggctggacgcagctgaccggcaccaccaacgtgtcctggaccgggacgctgtcgtccgccacgttctacgtggagacatccgcggggaccgacagtctttacgtcgacgacgcctcgctcgtcaacaactcgacgccgccgtccgggacgtgcgacctgccgtcgacctaccgctggtcgtccaccggtgtcctcgcgaccccgaaggccggctgggtatcgctgaaggacttcaccacggcgccgtacaacggccagcacctcgtctacgcgacgaccaacaccggggcctcgacaggaaccacgtggggctcgatgaacttcagcctcttcagcaactggtccgacatggcctccgccacgcagaacacgatgtcgtccgcgaccgtggccccgtcactcttctacttcgccccgaagaacatctgggtgctcacctaccagtggggcccaggcgccgccttcttctaccggacgtcgaacgaccccacgaacgcgaacggctggtcgtccgccaacgtcctcttctccgggtccatctccggctccagcaccggtcccatcgaccagacgatcatcggtgacggcacgaacatgtacctgttcttcgccggggacaacgggttcatctaccgggccagcatgccgatcggcaacttcccgggcagcttcggcagctcgtcgaccgtcgtcatgagcgacaccacgaacaacgggtggaacctgttcgaggcgccccaggtctacaagctcaaggaccagaacaagtacctcatgatcgtcgaggccatcggcgccaacggccggtacttccgctcgttcaccgcgaccagcctctccggctcgtggacgccgcaggccgcgaccgagagcaacccgttcgcgggcaaggccaacagcggtgccacctggaccaacgacatcagccacggtgagctcatccgcaccagcgccgaccagaccatgacgatcgacccctgcaacctgcagctgctgtaccagggccgctcccccagctccggtggggactacggcacgtggccgtaccggccgggcctgctcacgctgcagcgatag

SEQ ID NO: 110 - protein, 499 aa, Artificial Sequence
  Synthetic Construct
MKKPLGKIVASTALLISVAFSSSIASAHHHHHHPRASGNLLTNGDMENGTTGWSVFGAGSLASVTSPVHGGSRALSRTGRTAAWNGPAQTVTSVLTNNNSYTASVWVRSQSGTPTGRVTLQVTAGGTTNYVNLAQGTVNSSGWTQLTGTTNVSWTGTLSSATFYVETSAGTDSLYVDDASLVNNSTPPSGTCDLPSTYRWSSTGVLATPKAGWVSLKDFTTAPYNGQHLVYATTNTGASTGTTWGSMNFSLFSNWSDMASATQNTMSSATVAPSLFYFAPKNIWVLTYQWGPGAAFFYRTSNDPTNANGWSSANVLFSGSISGSSTGPIDQTIIGDGTNMYLFFAGDNGFIYRASMPIGNFPGSFGSSSTVVMSDTTNNGWNLFEAPQVYKLKDQNKYLMIVEAIGANGRYFRSFTATSLSGSWTPQAATESNPFAGKANSGATWTNDISHGELIRTSADQTMTIDPCNLQLLYQGRSPSSGGDYGTWPYRPGLLTLQR

SEQ ID NO: 111 - protein, 472 aa, Artificial Sequence
  Mature sequence with His-tag
  mat_peptide (1)..(472)
HHHHHHPRASGNLLTNGDMENGTTGWSVFGAGSLASVTSPVHGGSRALSRTGRTAAWNGPAQTVTSVLTNNNSYTASVWVRSQSGTPTGRVTLQVTAGGTTNYVNLAQGTVNSSGWTQLTGTTNVSWTGTLSSATFYVETSAGTDSLYVDDASLVNNSTPPSGTCDLPSTYRWSSTGVLATPKAGWVSLKDFTTAPYNGQHLVYATTNTGASTGTTWGSMNFSLFSNWSDMASATQNTMSSATVAPSLFYFAPKNIWVLTYQWGPGAAFFYRTSNDPTNANGWSSANVLFSGSISGSSTGPIDQTIIGDGTNMYLFFAGDNGFIYRASMPIGNFPGSFGSSSTVVMSDTTNNGWNLFEAPQVYKLKDQNKYLMIVEAIGANGRYFRSFTATSLSGSWTPQAATESNPFAGKANSGATWTNDISHGELIRTSADQTMTIDPCNLQLLYQGRSPSSGGDYGTWPYRPGLLTLQR

SEQ ID NO: 112 - DNA, 1149 bp, Microdochium nivale
  CDS (1)..(1146)
  sig_peptide (1)..(54)
  mat_peptide (55)..(1146)
atgaagttcaccactgccatcgccatcctggcgtcgacgacctcggtctcggcccagtgccagcttccctcctcataccagtggtctgactctggcgctctcgcccagcccaagagcggctggaagtcgcttaaggacttcacacacgtcaactacaacggccagaacctcgtttacgccacctaccacgatggcagcaagtgggggtccatggccttcagccctttcggcagctggtcaagcatggcctcagccgctcagaacactcagtcggccgctgccgtggcgcccactctcttcttcttcgcccccaagaacatctgggttcttgcctaccagtggggaggttccggtactttcacctacaagacttcgaccaacccgaccaaccccaacggctggggccccgcgcagacgctcttctcgggcaccatctcgggctccggcaccggcccgatcgatcagaccgtcattggtgacagtcagaacatgtacctcttcttcgccggcgacaacggcaagatctaccgcgccagcatgcccattggcaatttccctggcagcttcggcagctcatcgaccgttgtcatgagcgcctcgaccaacgacctcttcgaggccgtccaggtctacaccctcaagggccagaacaagtacctcatgctggttgaggcgatcggtgccaacggccgctacttccgctccttcacggccacctctctctcgggctcgtggaccgcccaggctgctactgagagcagacccttcgccggcaaggccaactccggtgccacctggaccaacgacatcagccacggcgacctcatccgtagcaacccggatcaaacctttaccgttgacccttgcaacctccagcttctttaccagggccgcaaccccaacagcggcaacgttgattaccctctgctgccataccgccctggcttgttgaccctcaagaacccctcaggtacgccatcgaccactactgccactgctgaccccgggacctcgccgacctccaaccccccctcaggaacatgtgctaaactatatgaccagtgcggcggtcaaggatacagcgggccgacgtgctgctcgacggggacatgtaaggcctccaacgagtggtactcgcagtgcgtctag

SEQ ID NO: 113 - protein, 382 aa, Microdochium nivale
MKFTTAIAILASTTSVSAQCQLPSSYQWSDSGALAQPKSGWKSLKDFTHVNYNGQNLVYATYHDGSKWGSMAFSPFGSWSSMASAAQNTQSAAAVAPTLFFFAPKNIWVLAYQWGGSGTFTYKTSTNPTNPNGWGPAQTLFSGTISGSGTGPIDQTVIGDSQNMYLFFAGDNGKIYRASMPIGNFPGSFGSSSTVVMSASTNDLFEAVQVYTLKGQNKYLMLVEAIGANGRYFRSFTATSLSGSWTAQAATESRPFAGKANSGATWTNDISHGDLIRSNPDQTFTVDPCNLQLLYQGRNPNSGNVDYPLLPYRPGLLTLKNPSGTPSTTTATADPGTSPTSNPPSGTCAKLYDQCGGQGYSGPTCCSTGTCKASNEWYSQCV

SEQ ID NO: 114 - protein, 364 aa, Microdochium nivale
  mat_peptide (1)..(364)
QCQLPSSYQWSDSGALAQPKSGWKSLKDFTHVNYNGQNLVYATYHDGSKWGSMAFSPFGSWSSMASAAQNTQSAAAVAPTLFFFAPKNIWVLAYQWGGSGTFTYKTSTNPTNPNGWGPAQTLFSGTISGSGTGPIDQTVIGDSQNMYLFFAGDNGKIYRASMPIGNFPGSFGSSSTVVMSASTNDLFEAVQVYTLKGQNKYLMLVEAIGANGRYFRSFTATSLSGSWTAQAATESRPFAGKANSGATWTNDISHGDLIRSNPDQTFTVDPCNLQLLYQGRNPNSGNVDYPLLPYRPGLLTLKNPSGTPSTTTATADPGTSPTSNPPSGTCAKLYDQCGGQGYSGPTCCSTGTCKASNEWYSQCV

SEQ ID NO: 115 - DNA, 1173 bp, Artificial Sequence
  Expression construct
  CDS (1)..(1170)
  sig_peptide (1)..(54)
  mat_peptide (55)..(1170)
atgaagttcaccactgccatcgccatcctggcgtcgacgacctcggtctcggcccagtgccagcttccctcctcataccagtggtctgactctggcgctctcgcccagcccaagagcggctggaagtcgcttaaggacttcacacacgtcaactacaacggccagaacctcgtttacgccacctaccacgatggcagcaagtgggggtccatggccttcagccctttcggcagctggtcaagcatggcctcagccgctcagaacactcagtcggccgctgccgtggcgcccactctcttcttcttcgcccccaagaacatctgggttcttgcctaccagtggggaggttccggtactttcacctacaagacttcgaccaacccgaccaaccccaacggctggggccccgcgcagacgctcttctcgggcaccatctcgggctccggcaccggcccgatcgatcagaccgtcattggtgacagtcagaacatgtacctcttcttcgccggcgacaacggcaagatctaccgcgccagcatgcccattggcaatttccctggcagcttcggcagctcatcgaccgttgtcatgagcgcctcgaccaacgacctcttcgaggccgtccaggtctacaccctcaagggccagaacaagtacctcatgctggttgaggcgatcggtgccaacggccgctacttccgctccttcacggccacctctctctcgggctcgtggaccgcccaggctgctactgagagcagacccttcgccggcaaggccaactccggtgccacctggaccaacgacatcagccacggcgacctcatccgtagcaacccggatcaaacctttaccgttgacccttgcaacctccagcttctttaccagggccgcaaccccaacagcggcaacgttgattaccctctgctgccataccgccctggcttgttgaccctcaagaacccctcaggtacgccatcgaccactactgccactgctgaccccgggacctcgccgacctccaaccccccctcaggaacatgtgctaaactatatgaccagtgcggcggtcaaggatacagcgggccgacgtgctgctcgacggggacatgtaaggcctccaacgagtggtactcgcagtgcgtccgacatcaccatcaccatcacccatga

SEQ ID NO: 116 - protein, 390 aa, Artificial Sequence
  Synthetic Construct
MKFTTAIAILASTTSVSAQCQLPSSYQWSDSGALAQPKSGWKSLKDFTHVNYNGQNLVYATYHDGSKWGSMAFSPFGSWSSMASAAQNTQSAAAVAPTLFFFAPKNIWVLAYQWGGSGTFTYKTSTNPTNPNGWGPAQTLFSGTISGSGTGPIDQTVIGDSQNMYLFFAGDNGKIYRASMPIGNFPGSFGSSSTVVMSASTNDLFEAVQVYTLKGQNKYLMLVEAIGANGRYFRSFTATSLSGSWTAQAATESRPFAGKANSGATWTNDISHGDLIRSNPDQTFTVDPCNLQLLYQGRNPNSGNVDYPLLPYRPGLLTLKNPSGTPSTTTATADPGTSPTSNPPSGTCAKLYDQCGGQGYSGPTCCSTGTCKASNEWYSQCVRHHHHHHP

SEQ ID NO: 117 - protein, 372 aa, Artificial Sequence
  Mature sequence with His-tag
  mat_peptide (1)..(372)
QCQLPSSYQWSDSGALAQPKSGWKSLKDFTHVNYNGQNLVYATYHDGSKWGSMAFSPFGSWSSMASAAQNTQSAAAVAPTLFFFAPKNIWVLAYQWGGSGTFTYKTSTNPTNPNGWGPAQTLFSGTISGSGTGPIDQTVIGDSQNMYLFFAGDNGKIYRASMPIGNFPGSFGSSSTVVMSASTNDLFEAVQVYTLKGQNKYLMLVEAIGANGRYFRSFTATSLSGSWTAQAATESRPFAGKANSGATWTNDISHGDLIRSNPDQTFTVDPCNLQLLYQGRNPNSGNVDYPLLPYRPGLLTLKNPSGTPSTTTATADPGTSPTSNPPSGTCAKLYDQCGGQGYSGPTCCSTGTCKASNEWYSQCVRHHHHHHP

SEQ ID NO: 118 - DNA, 1245 bp, Humicola hyalothermophila
  CDS (1)..(1135)
  sig_peptide (1)..(81)
  mat_peptide (82)..(1242)
  CDS (1226)..(1242)
atgaagttcgccaaaagcaatctcgggcccctctcagccggcaccgtgctgctggcctcgacgctcccggtagcccgggcccagtgcagcctcccgtccagctaccagtggacgtcgaccgggccgctcgccgaccccaagaacggctgggtctcgctcaaggacttcacccacgtcccctacaatggccagcatctggtgtacgcgacctacttcggctcgaactggggctccctgaacttcggcctcttctccgactggtccgaaatggcctcggccagccagaacggcatgtcgacgggcgcggtcgcgccgacgctgttcttcttcgagcccaagaacatctgggtgctcgcctaccagtggggcccgaccgccttctcgtaccgcacctcgaccgacccgaccaacccgaacggctggtccagcgtgcagccgctcttcaccggctccatctcggactcggacacgggcccgatcgaccagacgctgatcggcgacgaccagtacatgtacctcttcttcgccggcgacaacggcaagatctaccgctcgcgcatgcccatcggggacttcccgtccagcttcgggtcctcgtacgagatcatcatgagcggctcgcgcaacgacctgttcgaggcggtgcaggtgtacacggtcgacggcccgcagaagcagtacctcatgatcgtcgagtcgatcggcgccaacgggcgctacttccgctcctacacggccaccgacctcggcggctcgtggacgccgcaggccacgagcgagagcaacccgttcgcgggcaaggccaacagcggcgccacctggaccaacgacatcagccacggcgacctgatccgctccaagcccgaccagaccatgaccatcgacccctgcaacctgcagctgctctaccagggccgctccggcgacagctccgactacaacaccctgccctaccgccccggcctgctgaccctgcggggcgcccccggcggcggccagcccaacgacccggacccggaggaccccggcaacggcggcggcgagaccgttccgcgatggggccagtgcggcgggaatggctataccgggccgaccgagtgcgagagcccgtatacgtgcacgtatcagaatgattgtgagtttccttcctcgggttcccgtgcatctgtgctggatgagctggatgagagcgttatgggatgctaatcacatatcatttgcacagggtactcccaatgcttgtaa

SEQ ID NO: 119 - protein, 384 aa, Humicola hyalothermophila
MKFAKSNLGPLSAGTVLLASTLPVARAQCSLPSSYQWTSTGPLADPKNGWVSLKDFTHVPYNGQHLVYATYFGSNWGSLNFGLFSDWSEMASASQNGMSTGAVAPTLFFFEPKNIWVLAYQWGPTAFSYRTSTDPTNPNGWSSVQPLFTGSISDSDTGPIDQTLIGDDQYMYLFFAGDNGKIYRSRMPIGDFPSSFGSSYEIIMSGSRNDLFEAVQVYTVDGPQKQYLMIVESIGANGRYFRSYTATDLGGSWTPQATSESNPFAGKANSGATWTNDISHGDLIRSKPDQTMTIDPCNLQLLYQGRSGDSSDYNTLPYRPGLLTLRGAPGGGQPNDPDPEDPGNGGGETVPRWGQCGGNGYTGPTECESPYTCTYQNDWYSQCL

SEQ ID NO: 120 - protein, 357 aa, Humicola hyalothermophila
  mat_peptide (1)..(357)
QCSLPSSYQWTSTGPLADPKNGWVSLKDFTHVPYNGQHLVYATYFGSNWGSLNFGLFSDWSEMASASQNGMSTGAVAPTLFFFEPKNIWVLAYQWGPTAFSYRTSTDPTNPNGWSSVQPLFTGSISDSDTGPIDQTLIGDDQYMYLFFAGDNGKIYRSRMPIGDFPSSFGSSYEIIMSGSRNDLFEAVQVYTVDGPQKQYLMIVESIGANGRYFRSYTATDLGGSWTPQATSESNPFAGKANSGATWTNDISHGDLIRSKPDQTMTIDPCNLQLLYQGRSGDSSDYNTLPYRPGLLTLRGAPGGGQPNDPDPEDPGNGGGETVPRWGQCGGNGYTGPTECESPYTCTYQNDWYSQCL

SEQ ID NO: 121 - DNA, 981 bp, Curvularia geniculata
  CDS (1)..(978)
  sig_peptide (1)..(72)
  mat_peptide (73)..(978)
atgcgtttcgttcctaccgacatcagcttctccgcggctgcgctcgcgctcctggcttcgactgcgtctgcccaaagctgcaagcttcctaccacctacaagtggacctcctccggtgctcttgctcagcccaagtctggctgggcttccctgaaggacttcactatctccagccttaacggcaagcacattgtctacgctaccaaccacgacaccggctccaagtatggatccatgaacttcggtgccttcagcgacttcagccagatggcctctgcctcgcagaacggcatgagcttcactgctgttgctcctaccctcttccacttcgctcccaagaacgtctgggttcttgcctaccagtggggacccaccaccttctcctacaggacctccagcgaccccaccaacgccaacagctggggtgccgctcagcctcttttcactggcaagatcactggcagcagcaccggtgctattgaccagactgtcattggtgacagcaagaacatgtacctcttcttcgccggtgacaacggcaagatctaccgctccagcatgcccaaggccaacttccctggcaacttcggcactgcctccactgttatcatgagcgacaccgcccagaacctcttcgaggccgtccaggtctacactgtcaagggcggtggctacctcatgatcgttgaggcccagggtggaaacggccgttacttccgctctttcactgcttccagcctcgatggcgcctggacccccaacgccgccacccaggccaaccccttcgccggcaaggctaacagcggtgccacctggaccaacgacatctcccacggtgatcttgtcaagattaccaacgacgagaccatgactgtcgacccttgcaacctgcagctgttgtaccagggccgcaaccccaacgccggtggcgactacgaccgcctcccctacaggcccggtctccttaccctcaagaagtaa

SEQ ID NO: 122 - protein, 326 aa, Curvularia geniculata
MRFVPTDISFSAAALALLASTASAQSCKLPTTYKWTSSGALAQPKSGWASLKDFTISSLNGKHIVYATNHDTGSKYGSMNFGAFSDFSQMASASQNGMSFTAVAPTLFHFAPKNVWVLAYQWGPTTFSYRTSSDPTNANSWGAAQPLFTGKITGSSTGAIDQTVIGDSKNMYLFFAGDNGKIYRSSMPKANFPGNFGTASTVIMSDTAQNLFEAVQVYTVKGGGYLMIVEAQGGNGRYFRSFTASSLDGAWTPNAATQANPFAGKANSGATWTNDISHGDLVKITNDETMTVDPCNLQLLYQGRNPNAGGDYDRLPYRPGLLTLKK

SEQ ID NO: 123 - protein, 302 aa, Curvularia geniculata
  mat_peptide (1)..(302)
QSCKLPTTYKWTSSGALAQPKSGWASLKDFTISSLNGKHIVYATNHDTGSKYGSMNFGAFSDFSQMASASQNGMSFTAVAPTLFHFAPKNVWVLAYQWGPTTFSYRTSSDPTNANSWGAAQPLFTGKITGSSTGAIDQTVIGDSKNMYLFFAGDNGKIYRSSMPKANFPGNFGTASTVIMSDTAQNLFEAVQVYTVKGGGYLMIVEAQGGNGRYFRSFTASSLDGAWTPNAATQANPFAGKANSGATWTNDISHGDLVKITNDETMTVDPCNLQLLYQGRNPNAGGDYDRLPYRPGLLTLKK

SEQ ID NO: 124 - DNA, 1479 bp, Glycomyces rutgersensis
  CDS (1)..(1476)
  sig_peptide (1)..(117)
  mat_peptide (118)..(1476)
atggcctggatggaaaaccccaagagccgcaggcggatgctcatcggcggagccggcgtgctcgccggggccgccgccgcgaccgtactcaacccgttcaccaacgcggctgcagccgccacggtcgacacctccgcctggtatgtgctggtgaaccgcaacagcggcaaggccctggacgtcagcggtgcgtccaccgcagacggggccctggtgcaacagtggacccgcacgagcgccaacaaccagcagttccagttcgtggacgccggcggcggctactaccggatcagggcgcggcactcgggcaaggtgctcgacgtctccagctggtcgaccgccgacggtgccgccatccaccagtggaccgacaccggcggtgccaaccagcagttccggctggccgactccggcggcggctacgtccggttgatcaaccgcaacagcggcaaggcggtcgaggtccagggcgcggcgaccaacgacggcgcaagcgtcgtgcagtacagcgactggggcggcgccaaccagcaatggcagctcgccctcgtcgacggcggcagcggcgcctgcgcccttccgtcgacgtaccgctggacatcgacgggcccgctcgcacaaccgaagaacgggcaggtcgcgctcaaggacttcaccgccgtccgctacaacggccagtacctcgtctacgcgacgacgcacgacgccggaaccgcctggaactcggtggtcttcagccccttcaccaactggtccgacatggcctcggccggccagaccaggttgacgagcttcaacccggtggccccgacgctgatctacttcgcgccgaagaacatctgggtgctcgcctaccagtggggctggccgtacaagttctcctaccgcacgtcgaccaaccccgccgaccccaacagctggggcccgcaccaggagctcttcaacgggcagcttcccgtgaacaaccccatcgaccagaccctcatcgccgatgaccagaacatgtacctgttcttcgccaacgacgaaggccagatctaccgcgccagcatgcccctcggtaacttcccgagcagcttcggcacgagctaccagctcgtcatgagcgacacgaaggcgaacctgttcgaggcggtcgaggtctacaaggtccagggccagaaccagtacctcatgatcgtcgaggccatgggcagccggggtcgctacttccgctcgttcacggccaccagcctgaacggcacgtggacgccgcaggccgcgacggagagcaaccccttcgcgggcaaggccaacagcggtgccacgtggaccaacgacatcagccacggcgatctggtgcgcaccaaccccgaccagaccaagaccatcgacccctgcaacctgcagttcctctaccagggacgcgaccccagctctgacggcatggactacggcctcctgccctaccgcccgggtctgctgaccctgcagcgctaa

SEQ ID NO: 125 - protein, 492 aa, Glycomyces rutgersensis
MAWMENPKSRRRMLIGGAGVLAGAAAATVLNPFTNAAAAATVDTSAWYVLVNRNSGKALDVSGASTADGALVQQWTRTSANNQQFQFVDAGGGYYRIRARHSGKVLDVSSWSTADGAAIHQWTDTGGANQQFRLADSGGGYVRLINRNSGKAVEVQGAATNDGASVVQYSDWGGANQQWQLALVDGGSGACALPSTYRWTSTGPLAQPKNGQVALKDFTAVRYNGQYLVYATTHDAGTAWNSVVFSPFTNWSDMASAGQTRLTSFNPVAPTLIYFAPKNIWVLAYQWGWPYKFSYRTSTNPADPNSWGPHQELFNGQLPVNNPIDQTLIADDQNMYLFFANDEGQIYRASMPLGNFPSSFGTSYQLVMSDTKANLFEAVEVYKVQGQNQYLMIVEAMGSRGRYFRSFTATSLNGTWTPQAATESNPFAGKANSGATWTNDISHGDLVRTNPDQTKTIDPCNLQFLYQGRDPSSDGMDYGLLPYRPGLLTLQR

SEQ ID NO: 126 - protein, 453 aa, Glycomyces rutgersensis
  mat_peptide (1)..(453)
ATVDTSAWYVLVNRNSGKALDVSGASTADGALVQQWTRTSANNQQFQFVDAGGGYYRIRARHSGKVLDVSSWSTADGAAIHQWTDTGGANQQFRLADSGGGYVRLINRNSGKAVEVQGAATNDGASVVQYSDWGGANQQWQLALVDGGSGACALPSTYRWTSTGPLAQPKNGQVALKDFTAVRYNGQYLVYATTHDAGTAWNSVVFSPFTNWSDMASAGQTRLTSFNPVAPTLIYFAPKNIWVLAYQWGWPYKFSYRTSTNPADPNSWGPHQELFNGQLPVNNPIDQTLIADDQNMYLFFANDEGQIYRASMPLGNFPSSFGTSYQLVMSDTKANLFEAVEVYKVQGQNQYLMIVEAMGSRGRYFRSFTATSLNGTWTPQAATESNPFAGKANSGATWTNDISHGDLVRTNPDQTKTIDPCNLQFLYQGRDPSSDGMDYGLLPYRPGLLTLQR

SEQ ID NO: 127 - DNA, 1467 bp, Artificial Sequence
  Expression construct
  CDS (1)..(1464)
  sig_peptide (1)..(81)
  mat_peptide (82)..(1464)
atgaagaaaccgttggggaaaattgtcgcaagcaccgcactactcatttctgttgcttttagttcatcgatagcatcagcacatcatcatcaccatcatcctagggccacggtcgacacctccgcctggtatgtgctggtgaaccgcaacagcggcaaggccctggacgtcagcggtgcgtccaccgcagacggggccctggtgcaacagtggacccgcacgagcgccaacaaccagcagttccagttcgtggacgccggcggcggctactaccggatcagggcgcggcactcgggcaaggtgctcgacgtctccagctggtcgaccgccgacggtgccgccatccaccagtggaccgacaccggcggtgccaaccagcagttccggctggccgactccggcggcggctacgtccggttgatcaaccgcaacagcggcaaggcggtcgaggtccagggcgcggcgaccaacgacggcgcaagcgtcgtgcagtacagcgactggggcggcgccaaccagcaatggcagctcgccctcgtcgacggcggcagcggcgcctgcgcccttccgtcgacgtaccgctggacatcgacgggcccgctcgcacaaccgaagaacgggcaggtcgcgctcaaggacttcaccgccgtccgctacaacggccagtacctcgtctacgcgacgacgcacgacgccggaaccgcctggaactcggtggtcttcagccccttcaccaactggtccgacatggcctcggccggccagaccaggttgacgagcttcaacccggtggccccgacgctgatctacttcgcgccgaagaacatctgggtgctcgcctaccagtggggctggccgtacaagttctcctaccgcacgtcgaccaaccccgccgaccccaacagctggggcccgcaccaggagctcttcaacgggcagcttcccgtgaacaaccccatcgaccagaccctcatcgccgatgaccagaacatgtacctgttcttcgccaacgacgaaggccagatctaccgcgccagcatgcccctcggtaacttcccgagcagcttcggcacgagctaccagctcgtcatgagcgacacgaaggcgaacctgttcgaggcggtcgaggtctacaaggtccagggccagaaccagtacctcatgatcgtcgaggccatgggcagccggggtcgctacttccgctcgttcacggccaccagcctgaacggcacgtggacgccgcaggccgcgacggagagcaaccccttcgcgggcaaggccaacagcggtgccacgtggaccaacgacatcagccacggcgatctggtgcgcaccaaccccgaccagaccaagaccatcgacccctgcaacctgcagttcctctaccagggacgcgaccccagctctgacggcatggactacggcctcctgccctaccgcccgggtctgctgaccctgcagcgctaa

SEQ ID NO: 128 - protein, 488 aa, Artificial Sequence
  Synthetic Construct
MKKPLGKIVASTALLISVAFSSSIASAHHHHHHPRATVDTSAWYVLVNRNSGKALDVSGASTADGALVQQWTRTSANNQQFQFVDAGGGYYRIRARHSGKVLDVSSWSTADGAAIHQWTDTGGANQQFRLADSGGGYVRLINRNSGKAVEVQGAATNDGASVVQYSDWGGANQQWQLALVDGGSGACALPSTYRWTSTGPLAQPKNGQVALKDFTAVRYNGQYLVYATTHDAGTAWNSVVFSPFTNWSDMASAGQTRLTSFNPVAPTLIYFAPKNIWVLAYQWGWPYKFSYRTSTNPADPNSWGPHQELFNGQLPVNNPIDQTLIADDQNMYLFFANDEGQIYRASMPLGNFPSSFGTSYQLVMSDTKANLFEAVEVYKVQGQNQYLMIVEAMGSRGRYFRSFTATSLNGTWTPQAATESNPFAGKANSGATWTNDISHGDLVRTNPDQTKTIDPCNLQFLYQGRDPSSDGMDYGLLPYRPGLLTLQR

SEQ ID NO: 129 - protein, 461 aa, Artificial Sequence
  Mature sequence with His-tag
  mat_peptide (1)..(461)
HHHHHHPRATVDTSAWYVLVNRNSGKALDVSGASTADGALVQQWTRTSANNQQFQFVDAGGGYYRIRARHSGKVLDVSSWSTADGAAIHQWTDTGGANQQFRLADSGGGYVRLINRNSGKAVEVQGAATNDGASVVQYSDWGGANQQWQLALVDGGSGACALPSTYRWTSTGPLAQPKNGQVALKDFTAVRYNGQYLVYATTHDAGTAWNSVVFSPFTNWSDMASAGQTRLTSFNPVAPTLIYFAPKNIWVLAYQWGWPYKFSYRTSTNPADPNSWGPHQELFNGQLPVNNPIDQTLIADDQNMYLFFANDEGQIYRASMPLGNFPSSFGTSYQLVMSDTKANLFEAVEVYKVQGQNQYLMIVEAMGSRGRYFRSFTATSLNGTWTPQAATESNPFAGKANSGATWTNDISHGDLVRTNPDQTKTIDPCNLQFLYQGRDPSSDGMDYGLLPYRPGLLTLQR

SEQ ID NO: 130 - DNA, 1365 bp, Coprinopsis cinerea
  CDS (1)..(93)
  sig_peptide (1)..(60)
  mat_peptide (61)..(1362)
  CDS (152)..(162)
  CDS (216)..(262)
  CDS (323)..(1362)
atgggcgttctacgtgctcttctcgcagccagtctcctggccgtcactgttgtgaaggctcaaaccgctgaccactgggcccagtgcggtggggtgggtgactctttcctggcaagctcgaaatcgttactaacccgacttcctttcgcagagaggattcaggtaccacacctcactaattcgtctaggttctttgtctgactctcctgttacagtggccccaccacctgtgcaagtggcgccgtctgcactgtcgtgaatggtacactttcttgactgactgaatacgcgtcaggaagctgatcgatttaaaattttctagagtggtactcccaatgcattcccgggtccaacgcccctgctcctgctcctaccaccactcagcctgcccctgctcccgccccaagcgggaagctcccatccagcttcaggtggagctccagcggacccttgattggacccaagtccgactctaggaggattcaggggatcaaggatccatccgtggtctaccacgatggtcgctggcacgtttttgccagcacggcgaagactgagggctacaacctcgtctacatcagcttcactgattgggcccaagccggttccgcatcattctactaccttgaccaagctccacttgggaccgggtaccgcgccgcaccccaggtgttctacttcgctccccagcgcctctggtatcttgtgtaccaaaacggcaatgccgcctactctaccaatcccgacatcaacaacccggccggatggactgcaccccgcacgttctacagtggcatgcccgctattattcgcaacaacatcggcaatggacactgggtcgacatgtgggtcatttgcgactcttcgttgtgccacttgttctcgtcggacgacaacggtcatctgtatcgctcccaaacttccctctccaacttccctaacggcttcaacgagcccgtcatcgccatgcaggactccaataagaatcgactcttcgaggccgccaacgtatatcgcatcgacggtagcaatgaatacctcctcctccatgaagccatcggcagcgacggcaggaggtggttcaggtcttggacttcgaccagcattgcaggcccttggcgtgcacttgctgaccaagagtcgaaccccttcgcgagggcaaacaacgtggcgttcaccggtaatgcgtggaccagagacatcagccacggtgagctgatccgcagtggaaacgaccagaccctcccaatcagcccatgcaatcttcgctacctctaccagggtcttgaccccaactctggcggcgattacaacagccttccctggaagctcggtcttcttactcaaaccaactctgcttgttaa

SEQ ID NO: 131 - protein, 397 aa, Coprinopsis cinerea
MGVLRALLAASLLAVTVVKAQTADHWAQCGGRGFSGPTTCASGAVCTVVNEWYSQCIPGSNAPAPAPTTTQPAPAPAPSGKLPSSFRWSSSGPLIGPKSDSRRIQGIKDPSVVYHDGRWHVFASTAKTEGYNLVYISFTDWAQAGSASFYYLDQAPLGTGYRAAPQVFYFAPQRLWYLVYQNGNAAYSTNPDINNPAGWTAPRTFYSGMPAIIRNNIGNGHWVDMWVICDSSLCHLFSSDDNGHLYRSQTSLSNFPNGFNEPVIAMQDSNKNRLFEAANVYRIDGSNEYLLLHEAIGSDGRRWFRSWTSTSIAGPWRALADQESNPFARANNVAFTGNAWTRDISHGELIRSGNDQTLPISPCNLRYLYQGLDPNSGGDYNSLPWKLGLLTQTNSAC

SEQ ID NO: 132 - protein, 377 aa, Coprinopsis cinerea
  mat_peptide (1)..(337)
QTADHWAQCGGRGFSGPTTCASGAVCTVVNEWYSQCIPGSNAPAPAPTTTQPAPAPAPSGKLPSSFRWSSSGPLIGPKSDSRRIQGIKDPSVVYHDGRWHVFASTAKTEGYNLVYISFTDWAQAGSASFYYLDQAPLGTGYRAAPQVFYFAPQRLWYLVYQNGNAAYSTNPDINNPAGWTAPRTFYSGMPAIIRNNIGNGHWVDMWVICDSSLCHLFSSDDNGHLYRSQTSLSNFPNGFNEPVIAMQDSNKNRLFEAANVYRIDGSNEYLLLHEAIGSDGRRWFRSWTSTSIAGPWRALADQESNPFARANNVAFTGNAWTRDISHGELIRSGNDQTLPISPCNLRYLYQGLDPNSGGDYNSLPWKLGLLTQTNSAC

SEQ ID NO: 133 - DNA, 1389 bp, Artificial Sequence
  Expression construct
  CDS (1)..(93)
  sig_peptide (1)..(60)
  mat_peptide (61)..(1386)
  CDS (152)..(162)
  CDS (216)..(262)
  CDS (323)..(1386)
atgggcgttctacgtgctcttctcgcagccagtctcctggccgtcactgttgtgaaggctcaaaccgctgaccactgggcccagtgcggtggggtgggtgactctttcctggcaagctcgaaatcgttactaacccgacttcctttcgcagagaggattcaggtaccacacctcactaattcgtctaggttctttgtctgactctcctgttacagtggccccaccacctgtgcaagtggcgccgtctgcactgtcgtgaatggtacactttcttgactgactgaatacgcgtcaggaagctgatcgatttaaaattttctagagtggtactcccaatgcattcccgggtccaacgcccctgctcctgctcctaccaccactcagcctgcccctgctcccgccccaagcgggaagctcccatccagcttcaggtggagctccagcggacccttgattggacccaagtccgactctaggaggattcaggggatcaaggatccatccgtggtctaccacgatggtcgctggcacgtttttgccagcacggcgaagactgagggctacaacctcgtctacatcagcttcactgattgggcccaagccggttccgcatcattctactaccttgaccaagctccacttgggaccgggtaccgcgccgcaccccaggtgttctacttcgctccccagcgcctctggtatcttgtgtaccaaaacggcaatgccgcctactctaccaatcccgacatcaacaacccggccggatggactgcaccccgcacgttctacagtggcatgcccgctattattcgcaacaacatcggcaatggacactgggtcgacatgtgggtcatttgcgactcttcgttgtgccacttgttctcgtcggacgacaacggtcatctgtatcgctcccaaacttccctctccaacttccctaacggcttcaacgagcccgtcatcgccatgcaggactccaataagaatcgactcttcgaggccgccaacgtatatcgcatcgacggtagcaatgaatacctcctcctccatgaagccatcggcagcgacggcaggaggtggttcaggtcttggacttcgaccagcattgcaggcccttggcgtgcacttgctgaccaagagtcgaaccccttcgcgagggcaaacaacgtggcgttcaccggtaatgcgtggaccagagacatcagccacggtgagctgatccgcagtggaaacgaccagaccctcccaatcagcccatgcaatcttcgctacctctaccagggtcttgaccccaactctggcggcgattacaacagccttccctggaagctcggtcttcttactcaaaccaactctgcttgtcgacatcaccatcaccatcacccatga

SEQ ID NO: 134 - protein, 405 aa, Artificial Sequence
  Synthetic Construct
MGVLRALLAASLLAVTVVKAQTADHWAQCGGRGFSGPTTCASGAVCTVVNEWYSQCIPGSNAPAPAPTTTQPAPAPAPSGKLPSSFRWSSSGPLIGPKSDSRRIQGIKDPSVVYHDGRWHVFASTAKTEGYNLVYISFTDWAQAGSASFYYLDQAPLGTGYRAAPQVFYFAPQRLWYLVYQNGNAAYSTNPDINNPAGWTAPRTFYSGMPAIIRNNIGNGHWVDMWVICDSSLCHLFSSDDNGHLYRSQTSLSNFPNGFNEPVIAMQDSNKNRLFEAANVYRIDGSNEYLLLHEAIGSDGRRWFRSWTSTSIAGPWRALADQESNPFARANNVAFTGNAWTRDISHGELIRSGNDQTLPISPCNLRYLYQGLDPNSGGDYNSLPWKLGLLTQTNSACRHHHHHHP

SEQ ID NO: 135 - protein, 385 aa, Artificial Sequence
  Mature sequence with His-tag
  mat_peptide (1)..(385)
QTADHWAQCGGRGFSGPTTCASGAVCTVVNEWYSQCIPGSNAPAPAPTTTQPAPAPAPSGKLPSSFRWSSSGPLIGPKSDSRRIQGIKDPSVVYHDGRWHVFASTAKTEGYNLVYISFTDWAQAGSASFYYLDQAPLGTGYRAAPQVFYFAPQRLWYLVYQNGNAAYSTNPDINNPAGWTAPRTFYSGMPAIIRNNIGNGHWVDMWVICDSSLCHLFSSDDNGHLYRSQTSLSNFPNGFNEPVIAMQDSNKNRLFEAANVYRIDGSNEYLLLHEAIGSDGRRWFRSWTSTSIAGPWRALADQESNPFARANNVAFTGNAWTRDISHGELIRSGNDQTLPISPCNLRYLYQGLDPNSGGDYNSLPWKLGLLTQTNSACRHHHHHHP

SEQ ID NO: 136 - DNA, 1008 bp, Aspergillus aculeatus
  CDS (1)..(1005)
  sig_peptide (1)..(78)
  mat_peptide (79)..(1005)
atgaaattcctcaaggccaaagctggtctgctatcgtccggcatctgccttcttgtctctgcaccctttgcctccgcaagctgccctcttccttctacctactcctggacctcaaccggagctctcgcaactccgaagtcgggatggaccagcctgaaagacttcactgatgttgtttggaatggcaagcacatcgtctatgcatcaaccaccgataccaaaggtagctacgggtcgatgaccttcagtccattctccaactgggcggacatggctcaagccagccaaatcgccacgagcttcggtgccgtggcccccaccttgttctacttccagcccaagaacatctgggtgctcgccacccagtgggggtccagcactttcacctaccgcacctccaccgaccccaccaacgtcaacagctggtccgcagagcagcccctattctcgggccagatcggtagcggcgaaagttccggcacgggcgccatcgaccagaccgtgatcggggacgccacaaacatgtatctcttcttcgccggcgacaacggcaagatctaccgggccagcatgcccatcggcaacttccctgggaacttcggcacgcagtacgaggtggtgctcagtggcgcccggaacgatatcttcgaggcggtccaggtgtacaccgtccagggcggccagggccagagcaagtacctgatgatcgtcgaggcgatcggctcgactgggcgtcggtacttccggtccttcacggccagcagtctcggcggggcgtggacgccccaggcggccagcgagaaccagcccttcgcgggcaaggccaacagtggtgccacctggactcaggacattagtcacggcgacttagtgcgcaacaacccggaccagacgatgactgtcgatccttgtaacctccagttgctctatcagggcaaggaccccaacagcagtggcgactacaacacgcaaccgtggcggccgggtgtgctcactctgaagcactga

SEQ ID NO: 137 - protein, 335 aa, Aspergillus aculeatus
MKFLKAKAGLLSSGICLLVSAPFASASCPLPSTYSWTSTGALATPKSGWTSLKDFTDVVWNGKHIVYASTTDTKGSYGSMTFSPFSNWADMAQASQIATSFGAVAPTLFYFQPKNIWVLATQWGSSTFTYRTSTDPTNVNSWSAEQPLFSGQIGSGESSGTGAIDQTVIGDATNMYLFFAGDNGKIYRASMPIGNFPGNFGTQYEVVLSGARNDIFEAVQVYTVQGGQGQSKYLMIVEAIGSTGRRYFRSFTASSLGGAWTPQAASENQPFAGKANSGATWTQDISHGDLVRNNPDQTMTVDPCNLQLLYQGKDPNSSGDYNTQPWRPGVLTLKH

SEQ ID NO: 138 - protein, 309 aa, Aspergillus aculeatus
  mat_peptide (1)..(309)
SCPLPSTYSWTSTGALATPKSGWTSLKDFTDVVWNGKHIVYASTTDTKGSYGSMTFSPFSNWADMAQASQIATSFGAVAPTLFYFQPKNIWVLATQWGSSTFTYRTSTDPTNVNSWSAEQPLFSGQIGSGESSGTGAIDQTVIGDATNMYLFFAGDNGKIYRASMPIGNFPGNFGTQYEVVLSGARNDIFEAVQVYTVQGGQGQSKYLMIVEAIGSTGRRYFRSFTASSLGGAWTPQAASENQPFAGKANSGATWTQDISHGDLVRNNPDQTMTVDPCNLQLLYQGKDPNSSGDYNTQPWRPGVLTLKH

SEQ ID NO: 139 - DNA, 1131 bp, Remersonia thermophile
  CDS (1)..(358)
  sig_peptide (1)..(63)
  mat_peptide (64)..(1128)
  CDS (512)..(1128)
atgaagtctaccgtttcctcgatgggcctggccctcctggccacatcggtcggcgtcgcggctcagcagatctgcgatctcccttccacctaccggtggacgtcgaccggcccgttggccgagcctagatcgggatgggtctcgctcaaagacttcaccacggcgccgtacgagggcaagcaccttgtctacgccacgacgcatgactttggcaccacctggggatccatggcctttgggctggtgaacaacttcaccgagctccggacggcgccccagaccggtatgaaccaggcgacggtagcgccgagcttgttttacttcccgccgaaggatatctgggtgttggcgtatcagtgtaagtcttgttcctcagttcggacaagatgccatgttgcccccctctctctctccctccccccctcgcctacgtacctacctacctccacaagcacccgaggtacgtaaagcctgtgacagattgcccgatggctaaccgtgatgacctcagggggcccaaccgccttctcctacaaaacctcgcgcaacccgaccaaccccaacggctggggccctactcagaccctcttctcgggtcgcatcagcggctcctcgaccggccccatcgaccaagccctcatcggcgacgacaccaccatgtacctcttcttcgcgggcgacaacggtcgcatctaccgcgccagcatgcccatcggcaacttcccgggcagctttggctcctcgtcgaccatcatcatgcaggactcgaccaacaacctctttgaggccgtgcaggtgtacaagctccagggccagcaaaagtatctcatgattgtggaggcgatcggcgcgcagggccggtacttccggtccttcaccgcgacaagcctgggcgggagctggacgccgcaggccgcgagcgagggcaggccgttcgcgggcaaggcgaacagcggcgcgacgtggaccaacgacatcagccacggcgagctgatcagggtcagcgcggaccacaccatgaccattgatccgtgcaacctgcagctgctgtaccagggccgctcgccgaactcgggcggggattacgggaagttgccgtatcggcccgggttgttgacgttggtgcggtaa

SEQ ID NO: 140 - protein, 325 aa, Remersonia thermophile
MKSTVSSMGLALLATSVGVAAQQICDLPSTYRWTSTGPLAEPRSGWVSLKDFTTAPYEGKHLVYATTHDFGTTWGSMAFGLVNNFTELRTAPQTGMNQATVAPSLFYFPPKDIWVLAYQWGPTAFSYKTSRNPTNPNGWGPTQTLFSGRISGSSTGPIDQALIGDDTTMYLFFAGDNGRIYRASMPIGNFPGSFGSSSTIIMQDSTNNLFEAVQVYKLQGQQKYLMIVEAIGAQGRYFRSFTATSLGGSWTPQAASEGRPFAGKANSGATWTNDISHGELIRVSADHTMTIDPCNLQLLYQGRSPNSGGDYGKLPYRPGLLTLVR

SEQ ID NO: 141 - protein, 304 aa, Remersonia thermophile
  mat_peptide (1)..(304)
QQICDLPSTYRWTSTGPLAEPRSGWVSLKDFTTAPYEGKHLVYATTHDFGTTWGSMAFGLVNNFTELRTAPQTGMNQATVAPSLFYFPPKDIWVLAYQWGPTAFSYKTSRNPTNPNGWGPTQTLFSGRISGSSTGPIDQALIGDDTTMYLFFAGDNGRIYRASMPIGNFPGSFGSSSTIIMQDSTNNLFEAVQVYKLQGQQKYLMIVEAIGAQGRYFRSFTATSLGGSWTPQAASEGRPFAGKANSGATWTNDISHGELIRVSADHTMTIDPCNLQLLYQGRSPNSGGDYGKLPYRPGLLTLVR

SEQ ID NO: 142 - DNA, 1155 bp, Artificial Sequence
  Expression construct
  CDS (1)..(358)
  sig_peptide (1)..(63)
  mat_peptide (64)..(1152)
  CDS (512)..(1152)
atgaagtctaccgtttcctcgatgggcctggccctcctggccacatcggtcggcgtcgcggctcagcagatctgcgatctcccttccacctaccggtggacgtcgaccggcccgttggccgagcctagatcgggatgggtctcgctcaaagacttcaccacggcgccgtacgagggcaagcaccttgtctacgccacgacgcatgactttggcaccacctggggatccatggcctttgggctggtgaacaacttcaccgagctccggacggcgccccagaccggtatgaaccaggcgacggtagcgccgagcttgttttacttcccgccgaaggatatctgggtgttggcgtatcagtgtaagtcttgttcctcagttcggacaagatgccatgttgcccccctctctctctccctccccccctcgcctacgtacctacctacctccacaagcacccgaggtacgtaaagcctgtgacagattgcccgatggctaaccgtgatgacctcagggggcccaaccgccttctcctacaaaacctcgcgcaacccgaccaaccccaacggctggggccctactcagaccctcttctcgggtcgcatcagcggctcctcgaccggccccatcgaccaagccctcatcggcgacgacaccaccatgtacctcttcttcgcgggcgacaacggtcgcatctaccgcgccagcatgcccatcggcaacttcccgggcagctttggctcctcgtcgaccatcatcatgcaggactcgaccaacaacctctttgaggccgtgcaggtgtacaagctccagggccagcaaaagtatctcatgattgtggaggcgatcggcgcgcagggccggtacttccggtccttcaccgcgacaagcctgggcgggagctggacgccgcaggccgcgagcgagggcaggccgttcgcgggcaaggcgaacagcggcgcgacgtggaccaacgacatcagccacggcgagctgatcagggtcagcgcggaccacaccatgaccattgatccgtgcaacctgcagctgctgtaccagggccgctcgccgaactcgggcggggattacgggaagttgccgtatcggcccgggttgttgacgttggtgcggcgacatcaccatcaccatcacccatga

SEQ ID NO: 143 - protein, 333 aa, Artificial Sequence
  Synthetic Construct
MKSTVSSMGLALLATSVGVAAQQICDLPSTYRWTSTGPLAEPRSGWVSLKDFTTAPYEGKHLVYATTHDFGTTWGSMAFGLVNNFTELRTAPQTGMNQATVAPSLFYFPPKDIWVLAYQWGPTAFSYKTSRNPTNPNGWGPTQTLFSGRISGSSTGPIDQALIGDDTTMYLFFAGDNGRIYRASMPIGNFPGSFGSSSTIIMQDSTNNLFEAVQVYKLQGQQKYLMIVEAIGAQGRYFRSFTATSLGGSWTPQAASEGRPFAGKANSGATWTNDISHGELIRVSADHTMTIDPCNLQLLYQGRSPNSGGDYGKLPYRPGLLTLVRRHHHHHHP

SEQ ID NO: 144 - protein, 312 aa, Artificial Sequence
  Mature sequence with His-tag
  mat_peptide (1)..(312)
QQICDLPSTYRWTSTGPLAEPRSGWVSLKDFTTAPYEGKHLVYATTHDFGTTWGSMAFGLVNNFTELRTAPQTGMNQATVAPSLFYFPPKDIWVLAYQWGPTAFSYKTSRNPTNPNGWGPTQTLFSGRISGSSTGPIDQALIGDDTTMYLFFAGDNGRIYRASMPIGNFPGSFGSSSTIIMQDSTNNLFEAVQVYKLQGQQKYLMIVEAIGAQGRYFRSFTATSLGGSWTPQAASEGRPFAGKANSGATWTNDISHGELIRVSADHTMTIDPCNLQLLYQGRSPNSGGDYGKLPYRPGLLTLVRRHHHHHHP

SEQ ID NO: 145 - DNA, 987 bp, Penicillium soppii
  CDS (1)..(984)
  sig_peptide (1)..(78)
  mat_peptide (79)..(984)
atgatgttcttcaaggcggaggttggcctagtgtcatctgttttctttttgctcgcatcagcgccagctgtcgtcgctgactgcgcactcccgtcaacttacagttggacatccactggccctctcgtgaaccccaagtctgggtgggtggcacttaaggactttaccaacgtggtcttcaacaacaaacatgtcgtctatgcatcaactgccaatgcagctgggaactacggctctatgagcttcagccccttttccgattggtctggaatggcatctgcgagccaaaacgcaatgagcttcaacgctgttgcgcccactttgttctactttcagccaaagaatatttgggtcctggcctaccaatggggctcgagcacctttacttatcgaacatcaagtgatcctaccaccaatcaatggtcatcggagcaagcccttttctctggaaagatcgccaattcaggcactggtgctattgaccagacccttatcggcgactcgacacatatgtaccttttcttcgccggagacaatggcaaaatctaccgctctagcatgcctatcaacaatttcccaggaaatttcgggacgaactcagaggtggtgctcagtgacaccacgaacaacctgtttgaggcagttcaagtctacaccgtcaaagggcaaaacaagtaccttatgatcgttgaggcaataggatcacaagggcagcggtacttccgttcattcactgctagcagtctcggaggctcgtggactccccaggcaacgagcgagagtaatccctttgccggaaaggctaacagtggagcaacctggaccaacgacatcagtcacggcgacttggtccgcaccaaccccgaccaaacaatgacaatcgacccatgcaacctccagctcctctaccagggccgagacccgaatgccggtggccaatacaatgctcttccatacaagccgggcttgctcaccctgaagagatga

SEQ ID NO: 146 - protein, 328 aa, Penicillium soppii
MMFFKAEVGLVSSVFFLLASAPAVVADCALPSTYSWTSTGPLVNPKSGWVALKDFTNVVFNNKHVVYASTANAAGNYGSMSFSPFSDWSGMASASQNAMSFNAVAPTLFYFQPKNIWVLAYQWGSSTFTYRTSSDPTTNQWSSEQALFSGKIANSGTGAIDQTLIGDSTHMYLFFAGDNGKIYRSSMPINNFPGNFGTNSEVVLSDTTNNLFEAVQVYTVKGQNKYLMIVEAIGSQGQRYFRSFTASSLGGSWTPQATSESNPFAGKANSGATWTNDISHGDLVRTNPDQTMTIDPCNLQLLYQGRDPNAGGQYNALPYKPGLLTLKR

SEQ ID NO: 147 - protein, 302 aa, Penicillium soppii
  mat_peptide (1)..(302)
DCALPSTYSWTSTGPLVNPKSGWVALKDFTNVVFNNKHVVYASTANAAGNYGSMSFSPFSDWSGMASASQNAMSFNAVAPTLFYFQPKNIWVLAYQWGSSTFTYRTSSDPTTNQWSSEQALFSGKIANSGTGAIDQTLIGDSTHMYLFFAGDNGKIYRSSMPINNFPGNFGTNSEVVLSDTTNNLFEAVQVYTVKGQNKYLMIVEAIGSQGQRYFRSFTASSLGGSWTPQATSESNPFAGKANSGATWTNDISHGDLVRTNPDQTMTIDPCNLQLLYQGRDPNAGGQYNALPYKPGLLTLKR

SEQ ID NO: 148 - DNA, 978 bp, Bipolaris sorokiniana
  CDS (1)..(975)
  sig_peptide (1)..(69)
  mat_peptide (70)..(975)
atgcgtttcgttcccgaccttagcctctcggctgctgccgtcgtccttctggcttccactgcttcggcccagagctgcaagcttcccacctcttacaagtggacctcctccggcgctcttgcccagcccaagtccggatgggccaacttgaaggatttcaccatctccagcatcaacggcaagcacattgtctatgctaccaaccacgacactggatccaagtacggatccatggctttcagccccttcggtagcttcaacgagatggcctctgcctcccaggttgccacctccttcactgctgttgcccctaccctcttccgcttcgctcccaagaacatctgggtcatggcctaccagtggggacctaccaccttctcctacaggacctccagcgaccccaccaaccccaacagctggggtgccgtccagactctcttctccggcaagatcaccggcagcagcactggcgctattgaccagactgtcattggtgacgccaacaacatgtacctcttctttgccggtgacaacggcaagatctaccgttccagcatgcccaagggcaacttccctggcagcttcggcactgcttccaccgtcatcatgagcgacaccaccaacaacctcttcgaggctgttcaggtctacactgtcaagggcggcggttacctcatgatcgttgaggctatgggttctggcggccgttacttccgctctttcactgcctccagcctcaacggcagctggacccccaacgccgccactgagagcaaccccttcgccggcaaggccaacagcggtgccacctggaccaacgatatctcccacggtgaccttgtcaaggtcaccaacgacgagaccatgaccgtcgacccttgcaacctgcagctgttgtaccagggccgtgcccccaactctggcggcgactacgaccgcctcccctacaggcccggtctccttaccctcaagaagtag

SEQ ID NO: 149 - protein, 325 aa, Bipolaris sorokiniana
MRFVPDLSLSAAAVVLLASTASAQSCKLPTSYKWTSSGALAQPKSGWANLKDFTISSINGKHIVYATNHDTGSKYGSMAFSPFGSFNEMASASQVATSFTAVAPTLFRFAPKNIWVMAYQWGPTTFSYRTSSDPTNPNSWGAVQTLFSGKITGSSTGAIDQTVIGDANNMYLFFAGDNGKIYRSSMPKGNFPGSFGTASTVIMSDTTNNLFEAVQVYTVKGGGYLMIVEAMGSGGRYFRSFTASSLNGSWTPNAATESNPFAGKANSGATWTNDISHGDLVKVTNDETMTVDPCNLQLLYQGRAPNSGGDYDRLPYRPGLLTLKK

SEQ ID NO: 150 - protein, 302 aa, Bipolaris sorokiniana
  mat_peptide (1)..(302)
QSCKLPTSYKWTSSGALAQPKSGWANLKDFTISSINGKHIVYATNHDTGSKYGSMAFSPFGSFNEMASASQVATSFTAVAPTLFRFAPKNIWVMAYQWGPTTFSYRTSSDPTNPNSWGAVQTLFSGKITGSSTGAIDQTVIGDANNMYLFFAGDNGKIYRSSMPKGNFPGSFGTASTVIMSDTTNNLFEAVQVYTVKGGGYLMIVEAMGSGGRYFRSFTASSLNGSWTPNAATESNPFAGKANSGATWTNDISHGDLVKVTNDETMTVDPCNLQLLYQGRAPNSGGDYDRLPYRPGLLTLKK

SEQ ID NO: 151 - DNA, 1002 bp, Artificial Sequence
  Expression construct
  CDS (1)..(999)
  sig_peptide (1)..(69)
  mat_peptide (70)..(999)
atgcgtttcgttcccgaccttagcctctcggctgctgccgtcgtccttctggcttccactgcttcggcccagagctgcaagcttcccacctcttacaagtggacctcctccggcgctcttgcccagcccaagtccggatgggccaacttgaaggatttcaccatctccagcatcaacggcaagcacattgtctatgctaccaaccacgacactggatccaagtacggatccatggctttcagccccttcggtagcttcaacgagatggcctctgcctcccaggttgccacctccttcactgctgttgcccctaccctcttccgcttcgctcccaagaacatctgggtcatggcctaccagtggggacctaccaccttctcctacaggacctccagcgaccccaccaaccccaacagctggggtgccgtccagactctcttctccggcaagatcaccggcagcagcactggcgctattgaccagactgtcattggtgacgccaacaacatgtacctcttctttgccggtgacaacggcaagatctaccgttccagcatgcccaagggcaacttccctggcagcttcggcactgcttccaccgtcatcatgagcgacaccaccaacaacctcttcgaggctgttcaggtctacactgtcaagggcggcggttacctcatgatcgttgaggctatgggttctggcggccgttacttccgctctttcactgcctccagcctcaacggcagctggacccccaacgccgccactgagagcaaccccttcgccggcaaggccaacagcggtgccacctggaccaacgatatctcccacggtgaccttgtcaaggtcaccaacgacgagaccatgaccgtcgacccttgcaacctgcagctgttgtaccagggccgtgcccccaactctggcggcgactacgaccgcctcccctacaggcccggtctccttaccctcaagaagcgacatcaccatcaccatcacccatga

SEQ ID NO: 152 - protein, 333 aa, Artificial Sequence
  Synthetic Construct
MRFVPDLSLSAAAVVLLASTASAQSCKLPTSYKWTSSGALAQPKSGWANLKDFTISSINGKHIVYATNHDTGSKYGSMAFSPFGSFNEMASASQVATSFTAVAPTLFRFAPKNIWVMAYQWGPTTFSYRTSSDPTNPNSWGAVQTLFSGKITGSSTGAIDQTVIGDANNMYLFFAGDNGKIYRSSMPKGNFPGSFGTASTVIMSDTTNNLFEAVQVYTVKGGGYLMIVEAMGSGGRYFRSFTASSLNGSWTPNAATESNPFAGKANSGATWTNDISHGDLVKVTNDETMTVDPCNLQLLYQGRAPNSGGDYDRLPYRPGLLTLKKRHHHHHHP

SEQ ID NO: 153 - protein, 310 aa, Artificial Sequence
  Mature sequence with His-tag
  mat_peptide (1)..(310)
QSCKLPTSYKWTSSGALAQPKSGWANLKDFTISSINGKHIVYATNHDTGSKYGSMAFSPFGSFNEMASASQVATSFTAVAPTLFRFAPKNIWVMAYQWGPTTFSYRTSSDPTNPNSWGAVQTLFSGKITGSSTGAIDQTVIGDANNMYLFFAGDNGKIYRSSMPKGNFPGSFGTASTVIMSDTTNNLFEAVQVYTVKGGGYLMIVEAMGSGGRYFRSFTASSLNGSWTPNAATESNPFAGKANSGATWTNDISHGDLVKVTNDETMTVDPCNLQLLYQGRAPNSGGDYDRLPYRPGLLTLKKRHHHHHHP

SEQ ID NO: 154 - DNA, 1029 bp, Aspergillus fumigatiaffinis
  CDS (1)..(1026)
  sig_peptide (1)..(78)
  mat_peptide (79)..(1026)
atggtcctacgaaatgcacagcctttcgacacgatgaagttcttcctccttcttctcatctccaccattgccgcggcagccctgcccagcagcttcaaatggagctccagtgggcctctggtcagccccaagaacgatggccgcaacatcgcagctatcaaagatccctccattgtcgaagtgggcggcacctaccacgtcttcgccagcacggccaccaaatctggctacaacctcgtctacttcaacttcaaggacttcagccaggccaaccaggccactttccactaccttgaccaaaccccgatcggctcaggctatcgcgccgcgccccaggtcttcttcttcaagccacacaacctctggtacctggtcttccagaatggcaacgcagcttattcgaccaatccgaacattgctaacccagccgggtggagcaaaccgaagaatttcttcagtagcatgcccagcatcatcgcccagaataagggcaatggcaactgggtcgatatgtggactatctgcgattcaagcaactgctacctgttttcctctgatgacaacggccatctgtaccgttcgcagacctcgttggccaacttccccaacggcatgggcaatacggtgattgccatgtccgactccaacaagaacgctctgttcgaggcctcaaacgtctaccacaccgggaacggagagtatcttctcctcgttgaagccatcggcagcgatggacagcggtacttccgctcctggactgccaacagtctgaccggatcgtggaggggcctggccaacaccgagtctaatccctttgcgcgctcgaacaatgttgcgtttagcggcacgccttggacaaagagtatcagtcacggcgaggtgattcgcacgcagaccgatcagactatgacgatcagtccttgcaagctgcggtatctgtatcagggattgagcccgtctgcaggtggggattataacttgcttccttggaagcttggtcttcttacgcagacaaactctaattgttga

SEQ ID NO: 155 - protein, 342 aa, Aspergillus fumigatiaffinis
MVLRNAQPFDTMKFFLLLLISTIAAAALPSSFKWSSSGPLVSPKNDGRNIAAIKDPSIVEVGGTYHVFASTATKSGYNLVYFNFKDFSQANQATFHYLDQTPIGSGYRAAPQVFFFKPHNLWYLVFQNGNAAYSTNPNIANPAGWSKPKNFFSSMPSIIAQNKGNGNWVDMWTICDSSNCYLFSSDDNGHLYRSQTSLANFPNGMGNTVIAMSDSNKNALFEASNVYHTGNGEYLLLVEAIGSDGQRYFRSWTANSLTGSWRGLANTESNPFARSNNVAFSGTPWTKSISHGEVIRTQTDQTMTISPCKLRYLYQGLSPSAGGDYNLLPWKLGLLTQTNSNC

SEQ ID NO: 156 - protein, 316 aa, Aspergillus fumigatiaffinis
  mat_peptide (1)..(316)
ALPSSFKWSSSGPLVSPKNDGRNIAAIKDPSIVEVGGTYHVFASTATKSGYNLVYFNFKDFSQANQATFHYLDQTPIGSGYRAAPQVFFFKPHNLWYLVFQNGNAAYSTNPNIANPAGWSKPKNFFSSMPSIIAQNKGNGNWVDMWTICDSSNCYLFSSDDNGHLYRSQTSLANFPNGMGNTVIAMSDSNKNALFEASNVYHTGNGEYLLLVEAIGSDGQRYFRSWTANSLTGSWRGLANTESNPFARSNNVAFSGTPWTKSISHGEVIRTQTDQTMTISPCKLRYLYQGLSPSAGGDYNLLPWKLGLLTQTNSNC

SEQ ID NO: 157 - DNA, 996 bp, Neosartorya fischeri
  CDS (1)..(993)
  sig_peptide (1)..(45)
  mat_peptide (46)..(993)
atgaagctattcctcctccttctcatctccacccttgcggcggcagccctgcccagcagcttcaaatggagctccagcgggcctctggtcgatcccaagaacgatggccgcaacatcgcagctatcaaggatccctccattgtcgaagtggacgggacgtaccacgtcttcgccagcacggccacgaaatccggctacaacctcgtctacttcaacttcaaggacttcagccaggccaacaaggccactttccactaccttgaccagaccccgatcggctcgggctatcgtgccgcaccgcaggtcttcttcttcaagccacacaacctctggtacctggtcttccagaatggcaacgcagcttattcgactaatccaaacattgccaacccagccgggtggagcaaaccgaagaatttcttcagtagcatgcccagcatcatcgcccagaataagggcaatggcaactgggtcgacatgtggactatctgcgattcaagcaactgctacctgttttcctctgacgacaacggccatctgtaccgctcgcagacctctttggccaacttccccaacggcatgggcaatacagtgattgccctgtccgactccaacaagaacgccctgttcgaggcgtccaacgtctaccacacaggaaacggggaatatcttcttctcgttgaagccatcggcagcgatggacagcggtacttccgctcctggactgccaacagtctgaccggatcgtggaggggcctggccaacaccgaggcgaacccctttgcgcgctcgaacaacgttgcgttcagcgggacaccttggacaaagagtatcagtcacggggagattattcgcactcagactgatcagactatgactatcagtccttgcaagctgcggtatctgtatcagggattgagcccgtctgcaggtggggattacaacttgcttccttggaagcttggtctcctcacgcagaccaactctaactgctaa

SEQ ID NO: 158 - protein, 331 aa, Neosartorya fischeri
MKLFLLLLISTLAAAALPSSFKWSSSGPLVDPKNDGRNIAAIKDPSIVEVDGTYHVFASTATKSGYNLVYFNFKDFSQANKATFHYLDQTPIGSGYRAAPQVFFFKPHNLWYLVFQNGNAAYSTNPNIANPAGWSKPKNFFSSMPSIIAQNKGNGNWVDMWTICDSSNCYLFSSDDNGHLYRSQTSLANFPNGMGNTVIALSDSNKNALFEASNVYHTGNGEYLLLVEAIGSDGQRYFRSWTANSLTGSWRGLANTEANPFARSNNVAFSGTPWTKSISHGEIIRTQTDQTMTISPCKLRYLYQGLSPSAGGDYNLLPWKLGLLTQTNSNC

SEQ ID NO: 159 - protein, 316 aa, Neosartorya fischeri
  mat_peptide (1)..(316)
ALPSSFKWSSSGPLVDPKNDGRNIAAIKDPSIVEVDGTYHVFASTATKSGYNLVYFNFKDFSQANKATFHYLDQTPIGSGYRAAPQVFFFKPHNLWYLVFQNGNAAYSTNPNIANPAGWSKPKNFFSSMPSIIAQNKGNGNWVDMWTICDSSNCYLFSSDDNGHLYRSQTSLANFPNGMGNTVIALSDSNKNALFEASNVYHTGNGEYLLLVEAIGSDGQRYFRSWTANSLTGSWRGLANTEANPFARSNNVAFSGTPWTKSISHGEIIRTQTDQTMTISPCKLRYLYQGLSPSAGGDYNLLPWKLGLLTQTNSNC

SEQ ID NO: 160 - DNA, 960 bp, Thielavia arenaria
  CDS (1)..(957)
  sig_peptide (1)..(48)
  mat_peptide (49)..(957)
atgctcgccggtattactctgctggcttcggcggcggccgtcgcggcacagtcatgcgctctcccatcgacttaccgttggacctcgacgggaccgttggcccagccgaggtcgggatgggtctcgttgaaggacttcaccacggtcccctataacggccagaacctggtgtatgcgacgacccatgacacgggatcgagctgggggtcgatgaactttggcctcttcaggaactggactgatatggcctcggcaagccagaacgcaatgagcttttccgcggttgcgcctacactcttctacttcgcccccaaaaatatctgggtgctcgcctaccagtggggtccgaccacattctcgtatcggacttcaagcaatcccaccaacgcgaacggatggtcatcgccccagccactgtttaccggcaccatctcgggttccgacacaggccccatcgaccagaccctcattgccgacaaccagaacatgtacttgttcttcgcaggagacaacggcaagatctaccgggccagcatgcctctcaataatttcccaggcagtttcggcagcgcgtcgacggtcatcatgagcgatacaaagaacaacctgtttgaagcagtgcaggtctacaaggtccagggccagaaccagtatctcatgcttgtcgagtcgattggggccaacgggcgctacttccgttcctacacggccaccagcctggcgggttcgtggacgccacaggccacgtccgaaagccggccctttgccggaaaggcgaacagcggtgccacctggaccaacgacatcagccacggcgatctgattcgcgtcaacccggaccagactatgacggttgacccgtgcaggttgcaattgctctaccagggacgcgctcccaactcgggcggcgattacggaaaattgccctaccgcccgggcgtgctcaccctggtaagataa

SEQ ID NO: 161 - protein, 319 aa, Thielavia arenaria
MLAGITLLASAAAVAAQSCALPSTYRWTSTGPLAQPRSGWVSLKDFTTVPYNGQNLVYATTHDTGSSWGSMNFGLFRNWTDMASASQNAMSFSAVAPTLFYFAPKNIWVLAYQWGPTTFSYRTSSNPTNANGWSSPQPLFTGTISGSDTGPIDQTLIADNQNMYLFFAGDNGKIYRASMPLNNFPGSFGSASTVIMSDTKNNLFEAVQVYKVQGQNQYLMLVESIGANGRYFRSYTATSLAGSWTPQATSESRPFAGKANSGATWTNDISHGDLIRVNPDQTMTVDPCRLQLLYQGRAPNSGGDYGKLPYRPGVLTLVR

SEQ ID NO: 162 - protein, 303 aa, Thielavia arenaria
  mat_peptide (1)..(303)
QSCALPSTYRWTSTGPLAQPRSGWVSLKDFTTVPYNGQNLVYATTHDTGSSWGSMNFGLFRNWTDMASASQNAMSFSAVAPTLFYFAPKNIWVLAYQWGPTTFSYRTSSNPTNANGWSSPQPLFTGTISGSDTGPIDQTLIADNQNMYLFFAGDNGKIYRASMPLNNFPGSFGSASTVIMSDTKNNLFEAVQVYKVQGQNQYLMLVESIGANGRYFRSYTATSLAGSWTPQATSESRPFAGKANSGATWTNDISHGDLIRVNPDQTMTVDPCRLQLLYQGRAPNSGGDYGKLPYRPGVLTLVR

SEQ ID NO: 163 - DNA, 1227 bp, Chaetomium olivicolor
  CDS (1)..(1147)
  sig_peptide (1)..(81)
  mat_peptide (82)..(1224)
  CDS (1208)..(1224)
atgatgctctccaagaatcagatgggctcgctgtcggctgccatcgccctcctcgcgtcggtactccccgtcgcccaaggcgcgtgcagtcttccgtcaacctacaagtggacatcatctggtcccctggcgcagccgcggtcgggctgggcctcgctcaaggactttacccacgtgccctacaacggcaagcatctcgtctatgggtcatactacggagggagctatggctccatgaacttcggcctgttctctgactggtccgagatgggatcggcgagccagaacgccatgtcttcggctgccgtcgcaccgacgctctttcttttcgctcccaagaacatctggatcctggcctaccaatggggcccgactgccttctcctaccgcacttcgaccgaccccaccaatccgaacgggtggtcagcagcgcagccgctcttctccgggaccatcgcaggctcagataccggtcctatcgaccagacactgattggcgatagcacccacatgtatctgttcttcgcgggagataacggcaagatctataaagctcgaatgcctattgagaacttcccaggaaacttcggcactagctcggagatcatccttaacggcgcgaaaaacgatttcttcgaagccgtgcaggtctacaccgtcggcggccagagccagcctcagtacctcatgatcatcgaatcgatcggcgccaacgggcagcgctacttccgctcgtatacggccaccgacctcaacggcgcgtggactccacaagccacgagcgagagcaaccccttcgccggcaaggccaactccggcgccacctggaccgatgatatcagccacggcgacctgatccgcagtaacccggaccagaccatgaccatcgacccctgcaacttgcagctactctaccagggccgttctggctccagctcggactataacagcctcccctaccggccgggcctgctcacgttgcagggagcatccggcggtggcggcacaccgacgtcgagcaaaccgccttcgacaacgacgcccgctggcggcgcgacggctcccaggtacgcacaatgcggtggtcaggggtatacggggcctacggtctgcgagagtccctacaagtgcacttactctaatccttgtgagtccctcttgtttctcttctctcgtttaaatttttgctgacgaaatattcacatagggtactcccaatgcctataa

SEQ ID NO: 164 - protein, 388 aa, Chaetomium olivicolor
MMLSKNQMGSLSAAIALLASVLPVAQGACSLPSTYKWTSSGPLAQPRSGWASLKDFTHVPYNGKHLVYGSYYGGSYGSMNFGLFSDWSEMGSASQNAMSSAAVAPTLFLFAPKNIWILAYQWGPTAFSYRTSTDPTNPNGWSAAQPLFSGTIAGSDTGPIDQTLIGDSTHMYLFFAGDNGKIYKARMPIENFPGNFGTSSEIILNGAKNDFFEAVQVYTVGGQSQPQYLMIIESIGANGQRYFRSYTATDLNGAWTPQATSESNPFAGKANSGATWTDDISHGDLIRSNPDQTMTIDPCNLQLLYQGRSGSSSDYNSLPYRPGLLTLQGASGGGGTPTSSKPPSTTTPAGGATAPRYAQCGGQGYTGPTVCESPYKCTYSNPWYSQCL

SEQ ID NO: 165 - protein, 361 aa, Chaetomium olivicolor
  mat_peptide (1)..(361)
ACSLPSTYKWTSSGPLAQPRSGWASLKDFTHVPYNGKHLVYGSYYGGSYGSMNFGLFSDWSEMGSASQNAMSSAAVAPTLFLFAPKNIWILAYQWGPTAFSYRTSTDPTNPNGWSAAQPLFSGTIAGSDTGPIDQTLIGDSTHMYLFFAGDNGKIYKARMPIENFPGNFGTSSEIILNGAKNDFFEAVQVYTVGGQSQPQYLMIIESIGANGQRYFRSYTATDLNGAWTPQATSESNPFAGKANSGATWTDDISHGDLIRSNPDQTMTIDPCNLQLLYQGRSGSSSDYNSLPYRPGLLTLQGASGGGGTPTSSKPPSTTTPAGGATAPRYAQCGGQGYTGPTVCESPYKCTYSNPWYSQCL

SEQ ID NO: 166 - DNA, 1415 bp, Thielavia terricola
  CDS (1)..(318)
  sig_peptide (1)..(72)
  mat_peptide (73)..(1412)
  CDS (478)..(1333)
  CDS (1396)..(1412)
atgaagttcaccaagtcggatctcgcggccatcatcgccttcctggccgccggcctccccgtcgcccaaggcgcctgcagcctgccctcgagctacaagtggacttcgaccggtcccctcgcccagcccaagtccggctgggcctcgctcaaggacttcactcacgtcccctacaacggcaagcacctggtctatgcgtccaactacgccgggtccgcctatggctccatgaactttggcctcttcaccaactggtccgacatggccaccgccagccagaacggcatgtcccaggccgccgtggcgccgacgctctttgtaagtagacctcactgcttttatcaccgttttgggctgcattaggagtccagcaagtccagaagcgacacacttgcttctgacgaaaaccccttcccctttagttcatcaaccccttttccacccaaatacgcatgacatgactgactatttggacagtactttgagccgaagaagacgtgggttcttgcgtaccagtggggcgcgaccgccttctcctaccggacgtcgagcgacccgaccaacgcgaacggctggtcggccgcccagccgctcttctccgggtccatctccggctcggacaccggcccgatcgaccagaccctgatcggcgacgccaactacatgtacctgttctttgccggcgacaacggcaagatctaccgctccaagatgcccatcggcaacttcccgggcaacttcggcacctcggccgaggtcgtcctcagcggcgcccgcaacgacattttcgaggccgtccaggtctataccgttggcggacagagctccccgctctacttgatgcttgtggaaagcatcggcgccaacggccggtacttccgctcctacacggccaccagcctgggcggcaccttcaccccgcaggcgacctccgagtccaagcccttcgccggcaaggccaactcgggcgccacctggaccaacgacatcagccacggcgacctgatccgcagcaacccggaccagaccttcaccgtcgacccctgcaacctgcagctgctgtaccagggcctgcaggggactagctccgactacaacaagctgccctaccggcccggtctgctcacgctcgtgggcgccaccggcggcggcagcaacacgggtgggaccccgacgtcgagcaagccgcctgcgaccaccacgaccccggccaccggcggtggtggtagcagcggcggcgccacggctgcccactatgcgcagtgcggcgggcaggggtatacgggtccgacggtgtgcgagagcccgtataagtgcacttactcgaatgattgtgagtttctcgttcccctttcttgttcgtgatggaaatgttgctgaccatgtcttgtgtagggtactcccagtgcttgtaa

SEQ ID NO: 167 - protein, 397 aa, Thielavia terricola
MKFTKSDLAAIIAFLAAGLPVAQGACSLPSSYKWTSTGPLAQPKSGWASLKDFTHVPYNGKHLVYASNYAGSAYGSMNFGLFTNWSDMATASQNGMSQAAVAPTLFYFEPKKTWVLAYQWGATAFSYRTSSDPTNANGWSAAQPLFSGSISGSDTGPIDQTLIGDANYMYLFFAGDNGKIYRSKMPIGNFPGNFGTSAEVVLSGARNDIFEAVQVYTVGGQSSPLYLMLVESIGANGRYFRSYTATSLGGTFTPQATSESKPFAGKANSGATWTNDISHGDLIRSNPDQTFTVDPCNLQLLYQGLQGTSSDYNKLPYRPGLLTLVGATGGGSNTGGTPTSSKPPATTTTPATGGGGSSGGATAAHYAQCGGQGYTGPTVCESPYKCTYSNDWYSQCL

SEQ ID NO: 168 - protein, 373 aa, Thielavia terricola
  mat_peptide (1)..(373)
ACSLPSSYKWTSTGPLAQPKSGWASLKDFTHVPYNGKHLVYASNYAGSAYGSMNFGLFTNWSDMATASQNGMSQAAVAPTLFYFEPKKTWVLAYQWGATAFSYRTSSDPTNANGWSAAQPLFSGSISGSDTGPIDQTLIGDANYMYLFFAGDNGKIYRSKMPIGNFPGNFGTSAEVVLSGARNDIFEAVQVYTVGGQSSPLYLMLVESIGANGRYFRSYTATSLGGTFTPQATSESKPFAGKANSGATWTNDISHGDLIRSNPDQTFTVDPCNLQLLYQGLQGTSSDYNKLPYRPGLLTLVGATGGGSNTGGTPTSSKPPATTTTPATGGGGSSGGATAAHYAQCGGQGYTGPTVCESPYKCTYSNDWYSQCL

SEQ ID NO: 169 - DNA, 1283 bp, Thielavia terricola
  CDS (1)..(95)
  sig_peptide (1)..(66)
  mat_peptide (67)..(1280)
  CDS (229)..(469)
  CDS (534)..(940)
  CDS (1052)..(1280)
atgaagcttcccaacttggcaaccggcgccgttgccttcctggcggccgccgcgggcgtcgatgcccagtgccagctgcctgccaactaccgctggtacgtcaacactctaccccttttcacctgtctcgggaggcccctgctttgaagctgtgcccctactcccaaaaacactcttcagatactagtacttctcaagagacacaagatagcttacgcacttggacaggacctcgaccggccccctggcacagccgcacaacggctgggtggccctcaaggacttcacccacgtcccgtacaacggccagcacctggtctacggcaccatctttgacggccgcgtctggagctccatgaactttggcctgttccgcgactggaaccagatgggctccgtgtctcagaacaggatgaacacccctgccgtcgcgccgacgctgttcttcttccggcccaagaatatctgggtaggtctttacaccattccctcccaacccccctcgcaacaccttgctaacgttagattggcaggtcctcgcctaccaatggggccccaacgccttcaactaccgcacctccaacgaccctgccaatccgaacggctggggcccagtccagaccctcttcacgggcagcatcccagactcgcgcaccaacgtcatcgaccagacgctcatcgccgacgaccacaacatgtacctgttcttcgcgggcgacaacggccgcatctaccgcaccagcatgccgctcaacaattttcccggcaactttggtaaccagtggcagattgtcatgcaggacaccaccgagaacctgttcgagtcggtccaggtgtacaagttgctgggtctgaaccagtatctcatgattgtcgagtcgattgggaggagggggcggtacttccggtcgtatgtcgctgataggcttgatgggcagtggtatgtgtttccccctttacccccctatccctatttcccttcctccccttttccccctttcttcctcctcccatgttccatggcaattaacttactgacatcatgataaaggagggcccaggcgactaccgaagatcgtccttttgccggcaaggccaattccggcgcgggttggaccgacgacatctcccacggcgacctgatccgtgccacaccggacgaaaccttccccgtcgacccctgccacctgcagctgctgtaccagggccgcgcgcccggctccggcggtggcgactatgcccagtgggcgtaccggcctgctgtgttgacgctgcagcgttaa

SEQ ID NO: 170 - protein, 324 aa, Thielavia terricola
MKLPNLATGAVAFLAAAAGVDAQCQLPANYRWTSTGPLAQPHNGWVALKDFTHVPYNGQHLVYGTIFDGRVWSSMNFGLFRDWNQMGSVSQNRMNTPAVAPTLFFFRPKNIWVLAYQWGPNAFNYRTSNDPANPNGWGPVQTLFTGSIPDSRTNVIDQTLIADDHNMYLFFAGDNGRIYRTSMPLNNFPGNFGNQWQIVMQDTTENLFESVQVYKLLGLNQYLMIVESIGRRGRYFRSYVADRLDGQWRAQATTEDRPFAGKANSGAGWTDDISHGDLIRATPDETFPVDPCHLQLLYQGRAPGSGGGDYAQWAYRPAVLTLQR

SEQ ID NO: 171 - protein, 302 aa, Thielavia terricola
  mat_peptide (1)..(302)
QCQLPANYRWTSTGPLAQPHNGWVALKDFTHVPYNGQHLVYGTIFDGRVWSSMNFGLFRDWNQMGSVSQNRMNTPAVAPTLFFFRPKNIWVLAYQWGPNAFNYRTSNDPANPNGWGPVQTLFTGSIPDSRTNVIDQTLIADDHNMYLFFAGDNGRIYRTSMPLNNFPGNFGNQWQIVMQDTTENLFESVQVYKLLGLNQYLMIVESIGRRGRYFRSYVADRLDGQWRAQATTEDRPFAGKANSGAGWTDDISHGDLIRATPDETFPVDPCHLQLLYQGRAPGSGGGDYAQWAYRPAVLTLQR

SEQ ID NO: 172 - DNA, 1218 bp, Humicola sp.
  CDS (1)..(1132)
  sig_peptide (1)..(57)
  mat_peptide (58)..(1215)
  CDS (1199)..(1215)
atgaagctcaccactgccatctccttgctcgcgtcggggctccctgtggcctacagtgcgtgcagtcttccgtcaacctacaagtggacgtcgactggtcttctggcgaaccccaagtcgggctgggcctctctcaaagacttcactcacgtgccctacaatggcaagcaccttgtgtatgggtcctactacggaacggcctatggctccatgaactttggcctcttctctaactggtcagagatgggctcggtgagccagaacgccatgagctcggccgccgtcgcgccgacgctcttcttgttcgctcccaagaacatctggatcttggcctaccaatggggcccgaccgccttctcctaccgcacttcgaccgaccctaccaatgcgaacggatggtcggcagcgcagccgcttttctccggcaccatctccggctccgatactggccctattgaccagaccttgattggcgatagtacctacatgtatctattctttgcgggagacaacggcaagatctacaggtctaggatgcctctcggcaacttccctggaaacttcgggacctcggcggaagtcatcttgagcggcgcaagaaacgatctcttcgaagctgtccaggtctacaccgtcacaggccagagctcgccacagtacctcatgatcatcgagtccatcggcgccaacgggcgctacttccgctcgtacaccgccaccaacctgggcggctcgtggacaccgcaagccaccagcgagagcgcgccctttgcgggcaaggccaatagcggcgtgacctggactagcgatatcagccacggcgacctgatccgcagcggccctgaccagaccatgcccatcgacccttgcaacctgcagctgctctaccaggggcggtctggcgacagctccgactacaacaagctgccctaccggcccggcctgctcacgctacagggcaccaacggcggcggcggcacgccgacaacgtcgagcaagccgccctctaccacgacggtgtccccgggcggcggcggctcgactgccccgcactatgctcagtgtggtggccagggatacacaggcccgacgacgtgcgagagcccgtacaagtgcacgtactccaatccttgtgagtttctctagccccccttttcgcttttcatgattacatcgcttgctgacgagatctacgtagggtactcccagtgtctgtaa

SEQ ID NO: 173 - protein, 383 aa, Humicola sp.
MKLTTAISLLASGLPVAYSACSLPSTYKWTSTGLLANPKSGWASLKDFTHVPYNGKHLVYGSYYGTAYGSMNFGLFSNWSEMGSVSQNAMSSAAVAPTLFLFAPKNIWILAYQWGPTAFSYRTSTDPTNANGWSAAQPLFSGTISGSDTGPIDQTLIGDSTYMYLFFAGDNGKIYRSRMPLGNFPGNFGTSAEVILSGARNDLFEAVQVYTVTGQSSPQYLMIIESIGANGRYFRSYTATNLGGSWTPQATSESAPFAGKANSGVTWTSDISHGDLIRSGPDQTMPIDPCNLQLLYQGRSGDSSDYNKLPYRPGLLTLQGTNGGGGTPTTSSKPPSTTTVSPGGGGSTAPHYAQCGGQGYTGPTTCESPYKCTYSNPWYSQCL

SEQ ID NO: 174 - protein, 364 aa, Humicola sp.
  mat_peptide (1)..(364)
ACSLPSTYKWTSTGLLANPKSGWASLKDFTHVPYNGKHLVYGSYYGTAYGSMNFGLFSNWSEMGSVSQNAMSSAAVAPTLFLFAPKNIWILAYQWGPTAFSYRTSTDPTNANGWSAAQPLFSGTISGSDTGPIDQTLIGDSTYMYLFFAGDNGKIYRSRMPLGNFPGNFGTSAEVILSGARNDLFEAVQVYTVTGQSSPQYLMIIESIGANGRYFRSYTATNLGGSWTPQATSESAPFAGKANSGVTWTSDISHGDLIRSGPDQTMPIDPCNLQLLYQGRSGDSSDYNKLPYRPGLLTLQGTNGGGGTPTTSSKPPSTTTVSPGGGGSTAPHYAQCGGQGYTGPTTCESPYKCTYSNPWYSQCL

SEQ ID NO: 175 - DNA, 1204 bp, Ustilago maydis
  CDS (1)..(492)
  sig_peptide (1)..(63)
  mat_peptide (64)..(1201)
  CDS (571)..(988)
  CDS (1080)..(1201)
atgaagaccaactttctcgttctcctctccgcccttctcgcagcttcttcagccgtgaccgccacgctgatccctgccaagtgcaaacacgaggcgttctcgcagagagctggctcgtcgctcaacgcagccatcaagtcggatggtcgcaagtactttggtacttgcgccgacccgggcacgttgggcaattggcagatcagcaacatcatcaaggctgagatgggtcaggtgaccccggaaaattcgatgaagtgggatgccactcaaccgcagcgcggcacgtttaactttggcaatgccgatcggctcgtagactttgccacctcaaatggaaagctgatccgaggtcatacgctcgtctggcactcgcagcttccttcatgggtctcgtccattactgacgccaatgaccttaccaacgtaattcagaaccgaatcgccaccgttgtgggaagatacaagggcaaggtctacgcctgggatgtagtggtaagcacagtggcttgtttgtatcaagcagatgcctatactaggtactgactcagctttcataatgtcccaaaatagaacgagatgttcaacgagaacggttcattccgcgagagcgttttctacaagctcctcggcgaggactttgtcaagatcgccttcgaagcggccaggaaggcggacccgaacgccaaactctacatcaacgactacaatctcgacgatcccgattatccgaagctcaagtcgctcgttgctaacgtcaaaaagtggcggtcgcagggtgtcccgatcgacgggatcggctctcaatcgcatctgcaggcggctggtcatttcctcgacgcctcaaaggttggcggtgccatgcaggcgctttgtgctgctgcgtcggagtgcgccatgaccgagctagacattgctcaagccagccctgaccagtataccaaggctaccgaggcctgcctcaaccagaagaactgcgttggcatcaccggtacgtatcctacatcaatcttgcatccagacctagagttaaccctcactgacattatctttgctctcgcgtgcactcatcatgatcatagtttggggtgtttctgacaacacttcatggaggaaaaacgccaaccctttgctttggaacagcagctaccagaagaagcctgcttacaacgccgtgcttagcactctcaactcgtaccaagcttga

SEQ ID NO: 176 - protein, 344 aa, Ustilago maydis
MKTNFLVLLSALLAASSAVTATLIPAKCKHEAFSQRAGSSLNAAIKSDGRKYFGTCADPGTLGNWQISNIIKAEMGQVTPENSMKWDATQPQRGTFNFGNADRLVDFATSNGKLIRGHTLVWHSQLPSWVSSITDANDLTNVIQNRIATVVGRYKGKVYAWDVVNEMFNENGSFRESVFYKLLGEDFVKIAFEAARKADPNAKLYINDYNLDDPDYPKLKSLVANVKKWRSQGVPIDGIGSQSHLQAAGHFLDASKVGGAMQALCAAASECAMTELDIAQASPDQYTKATEACLNQKNCVGITVWGVSDNTSWRKNANPLLWNSSYQKKPAYNAVLSTLNSYQA

SEQ ID NO: 177 - protein, 323 aa, Ustilago maydis
  mat_peptide (1)..(323)
TLIPAKCKHEAFSQRAGSSLNAAIKSDGRKYFGTCADPGTLGNWQISNIIKAEMGQVTPENSMKWDATQPQRGTFNFGNADRLVDFATSNGKLIRGHTLVWHSQLPSWVSSITDANDLTNVIQNRIATVVGRYKGKVYAWDVVNEMFNENGSFRESVFYKLLGEDFVKIAFEAARKADPNAKLYINDYNLDDPDYPKLKSLVANVKKWRSQGVPIDGIGSQSHLQAAGHFLDASKVGGAMQALCAAASECAMTELDIAQASPDQYTKATEACLNQKNCVGITVWGVSDNTSWRKNANPLLWNSSYQKKPAYNAVLSTLNSYQA

SEQ ID NO: 178 - DNA, 1228 bp, Artificial Sequence
  Expression construct
  CDS (1)..(492)
  sig_peptide (1)..(63)
  mat_peptide (64)..(1225)
  CDS (571)..(988)
  CDS (1080)..(1225)
atgaagaccaactttctcgttctcctctccgcccttctcgcagcttcttcagccgtgaccgccacgctgatccctgccaagtgcaaacacgaggcgttctcgcagagagctggctcgtcgctcaacgcagccatcaagtcggatggtcgcaagtactttggtacttgcgccgacccgggcacgttgggcaattggcagatcagcaacatcatcaaggctgagatgggtcaggtgaccccggaaaattcgatgaagtgggatgccactcaaccgcagcgcggcacgtttaactttggcaatgccgatcggctcgtagactttgccacctcaaatggaaagctgatccgaggtcatacgctcgtctggcactcgcagcttccttcatgggtctcgtccattactgacgccaatgaccttaccaacgtaattcagaaccgaatcgccaccgttgtgggaagatacaagggcaaggtctacgcctgggatgtagtggtaagcacagtggcttgtttgtatcaagcagatgcctatactaggtactgactcagctttcataatgtcccaaaatagaacgagatgttcaacgagaacggttcattccgcgagagcgttttctacaagctcctcggcgaggactttgtcaagatcgccttcgaagcggccaggaaggcggacccgaacgccaaactctacatcaacgactacaatctcgacgatcccgattatccgaagctcaagtcgctcgttgctaacgtcaaaaagtggcggtcgcagggtgtcccgatcgacgggatcggctctcaatcgcatctgcaggcggctggtcatttcctcgacgcctcaaaggttggcggtgccatgcaggcgctttgtgctgctgcgtcggagtgcgccatgaccgagctagacattgctcaagccagccctgaccagtataccaaggctaccgaggcctgcctcaaccagaagaactgcgttggcatcaccggtacgtatcctacatcaatcttgcatccagacctagagttaaccctcactgacattatctttgctctcgcgtgcactcatcatgatcatagtttggggtgtttctgacaacacttcatggaggaaaaacgccaaccctttgctttggaacagcagctaccagaagaagcctgcttacaacgccgtgcttagcactctcaactcgtaccaagctcgacatcaccatcaccatcacccatga

SEQ ID NO: 179 - protein, 352 aa, Artificial Sequence
  Synthetic Construct
MKTNFLVLLSALLAASSAVTATLIPAKCKHEAFSQRAGSSLNAAIKSDGRKYFGTCADPGTLGNWQISNIIKAEMGQVTPENSMKWDATQPQRGTFNFGNADRLVDFATSNGKLIRGHTLVWHSQLPSWVSSITDANDLTNVIQNRIATVVGRYKGKVYAWDVVNEMFNENGSFRESVFYKLLGEDFVKIAFEAARKADPNAKLYINDYNLDDPDYPKLKSLVANVKKWRSQGVPIDGIGSQSHLQAAGHFLDASKVGGAMQALCAAASECAMTELDIAQASPDQYTKATEACLNQKNCVGITVWGVSDNTSWRKNANPLLWNSSYQKKPAYNAVLSTLNSYQARHHHHHHP

SEQ ID NO: 180 - protein, 331 aa, Artificial Sequence
  Mature sequence with His-tag
  mat_peptide (1)..(331)
TLIPAKCKHEAFSQRAGSSLNAAIKSDGRKYFGTCADPGTLGNWQISNIIKAEMGQVTPENSMKWDATQPQRGTFNFGNADRLVDFATSNGKLIRGHTLVWHSQLPSWVSSITDANDLTNVIQNRIATVVGRYKGKVYAWDVVNEMFNENGSFRESVFYKLLGEDFVKIAFEAARKADPNAKLYINDYNLDDPDYPKLKSLVANVKKWRSQGVPIDGIGSQSHLQAAGHFLDASKVGGAMQALCAAASECAMTELDIAQASPDQYTKATEACLNQKNCVGITVWGVSDNTSWRKNANPLLWNSSYQKKPAYNAVLSTLNSYQARHHHHHHP

What is claimed is:

1. A composition comprising
a GH10 polypeptide having xylanase activity at least 85% sequence identity to the polypeptide of SEQ ID NO: 70, and
a GH62 polypeptide having arabinofuranosidase activity and at least 85% sequence identity to the polypeptide of SEQ ID NO: 12,
wherein:
(a) the GH10 polypeptide and the GH62 polypeptide together solubilise at least 2.0% xylose from defatted destarched maize (DFDSM); and
(b) the GH10 polypeptide and the GH62 polypeptide together solubilise at least 2 times more xylose from DFDSM than the GH10 polypeptide in the absence of the GH62 polypeptide;
wherein (a) and (b) are performed under the reaction conditions: (i) 25 mg GH10 polypeptide per kg DFDSM, (ii) 12.5 mg GH62 polypeptide per kg DFDSM, and (iii) incubation at 40° C., pH 5 for 4 hours.

2. The composition of claim 1, wherein
the GH10 polypeptide has at least 90% sequence identity to the polypeptide of SEQ ID NO: 70, and
the GH62 polypeptide has at least 90% sequence identity to the polypeptide of SEQ ID NO: 12.

3. The composition of claim 1, wherein
the GH10 polypeptide has at least 95% sequence identity to the polypeptide of SEQ ID NO: 70, and
the GH62 polypeptide has at least 95% sequence identity to the polypeptide of SEQ ID NO: 12.

4. The composition of claim 1, wherein
GH10 polypeptide has at least 346 amino acid residues and has xylanase activity, and
the GH62 polypeptide has at least 273 amino acid residues and has arabinofuranosidase activity.

5. The composition of claim 1, wherein
the GH10 polypeptide has at least 85% sequence identity to the polypeptide of SEQ ID NO: 70 with one or more amino acid substitutions, deletions and/or insertions to the polypeptide of SEQ ID NO: 70, and
the GH62 polypeptide has at least 85% sequence identity to the polypeptide of SEQ ID NO: 12 with one or more amino acid substitutions, deletions and/or insertions to the polypeptide of SEQ ID NO: 12.

6. The composition of claim 1, wherein
the GH10 polypeptide comprises SEQ ID NO: 70, and
the GH62 polypeptide comprises SEQ ID NO: 12.

7. An animal feed additive comprising the composition of claim 1 and one or more components selected from the list consisting of:
one or more vitamins;
one or more minerals;
one or more amino acids; and
one or more other feed ingredients.

8. An animal feed comprising the composition of claim 1 and plant-based material from the sub-family Panicoideae.

9. A method of improving one or more performance parameters of an animal comprising administering to one or more animals the composition of claim 1.

10. A method of solubilising xylose from plant based material, comprising treating plant based material from the sub-family Panicoideae with the composition of claim 1.

11. A method of releasing starch from plant based material, comprising treating plant based material from the sub-family Panicoideae with the composition of claim 1.

12. A method for improving the nutritional value of an animal feed, comprising adding to the feed the composition of claim 1.

13. A method of preparing an animal feed, comprising mixing the composition of claim 1 with plant based material from the sub-family Panicoideae.

\* \* \* \* \*

UNITED STATES PATENT AND TRADEMARK OFFICE
CERTIFICATE OF CORRECTION

PATENT NO. : 10,711,259 B2
APPLICATION NO. : 15/528910
DATED : July 14, 2020
INVENTOR(S) : Peng et al.

Page 1 of 1

It is certified that error appears in the above-identified patent and that said Letters Patent is hereby corrected as shown below:

On the Title Page

Item (30) (Foreign Application Priority Data), please delete "PCT/CN2014/094831" and insert -- PCT/CN2014/094381 --.

In the Claims

In Claim 4, Line 2, please insert -- the -- before "GH10".

Signed and Sealed this
Third Day of November, 2020

Andrei Iancu
*Director of the United States Patent and Trademark Office*